United States Patent 11,141,474 (ARTIFICIAL NUCLEIC ACID MOLECULES ENCODING A NOROVIRUS ANTIGEN AND USES THEREOF) - sequence listing, part 2

SEQ ID NO: 3710 - protein, 538 aa, Artificial Sequence
  VP1__Norovirus_and/or_Norovirus-like__JN400624
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNDRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHSVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3711 - protein, 538 aa, Artificial Sequence
  VP1__Norovirus_and/or_Norovirus-like__EU876894
MKMASSDANPSDGSTANLVPEVNNEVMALEPVVGAAIAAPVAGQQNVIDPRIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCWVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQEYTMNLASQNWNNYDPTEEIPAPLGTPDFVGKIQGVLTQTTRSDGSTRGHKATVSTGSVHFTPKLGRIQFSTDTSNDFETGQNTRFTPVGVVQDGSTTHQNEPQQWVLPNYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3712 - protein, 538 aa, Artificial Sequence
  VP1__Norovirus_and/or_Norovirus-like__KX514173
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPVNLERLFTGPSSANVVQPQNGRCTIDGELLGTTQLSSVNICTFRGDVTHIGTTRHWTMNLASPNWNNYDPTEETPAPLGTPDFVGKIQGMLTQTTKGEGSTRGHRATVYVGSANYAPKLGRVQFETDTTNDLDAHQNTKFTPVGVVQGGESPKGSEPQQWVLPSYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3713 - protein, 538 aa, Artificial Sequence
  VP1__Norovirus_and/or_Norovirus-like__KX353989
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMVPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIPGSHNYTMNLASQNWNSYDPTEEIPAPLGTPDFVGKIQGVLTQTTSTNGSTRGHKATVYTGSADFSPKLGRVQFATDTNNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3714 - protein, 538 aa, Artificial Sequence
  VP1__Norovirus_and/or_Norovirus-like__KX353962
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNPRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQDTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3715 - protein, 538 aa, Artificial Sequence
  VP1__Norovirus_and/or_Norovirus-like__AB972515
MKMASSDANPSDGSTANLVPEVNNEVMALEPVIGAAIAAPVAGQQNVIDPWIRNNFVQAPGGEFTVSPRNAPGEILWSAPLGPDLNPYLSHLSRMYNGYAGGFEVQVILAGNAFTAGKIIFAAVPPNFPTEGLSPSQVTMFPHMIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3716 - protein, 538 aa, Artificial Sequence
  VP1__Norovirus_and/or_Norovirus-like__KT033904
MKMASNDANPSDGSAANLVPKVNNEVMALEPVVGAAIAAPVAGQQNVIDPWIKNNFVQAPGGKFTVSPKNAPGEILWSAPLGPDLNPYLSHLARMYKGHAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3717 - protein, 538 aa, Artificial Sequence
  VP1__Norovirus_and/or_Norovirus-like__KM982942
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWSNYDPTEEIPAPLGTPDFVGKIQGVLTQTTRTDGSTRGHKATVYIGSADFAPKLGRVQFETDTNHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSRVNQFYTLAPMGNGTGRRR

SEQ ID NO: 3718 - protein, 538 aa, Artificial Sequence
  VP1__Norovirus_and/or_Norovirus-like__KJ685417
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVIHISGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3719 - protein, 538 aa, Artificial Sequence
  VP1__Norovirus_and/or_Norovirus-like__KC907392
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRSPIPLEKLFTGPSSAFVVQPQNGRCTTDGVLLGTTQLSPVNICTFRGDVAHIAGTQNYTMNLASQNWNNYDPTEEIPAPLGTPNFVGKIQGVLTQTTKRDGSTRGRKATVSTGSVHFTPKLGSVQFSTDTSNDFETGQNTRFTPVGVVQDGSTTHRNEPQQWVLPDYSGRDSHNVHLAPAVAPTFPGEQLLFFRSSMPGCSGYPNMDLDCLLPQEWVQHFYQESAPAQSDVALLRFVNPDTGRVLFECKLHKSGYVTVAHTGQHDLVIPPNGYSRFDSWVNQFYTLAPMGNGAGRRR

SEQ ID NO: 3720 - protein, 538 aa, Artificial Sequence
  VP1__Norovirus_and/or_Norovirus-like__KC517377
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYAPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPNTGRVLFECKLHKSGYVTVAHTGQHDLVIPPNDYFRFDSWVNQFYTLAPMGNGTGRRR

SEQ ID NO: 3721 - protein, 538 aa, Artificial Sequence
  VP1__Norovirus_and/or_Norovirus-like__KC517368
MKMASNDANPSDGSAANLVPEVNNEVMALEPVVGAAIAAPVAGQQNVIDPWIRNNFAQAPGGEFTVSPRNAPGEILWSAPLGPDLNPYLSHLARMYNGYAGGFEVQVILAENAFTAGKIIFAAVPPNFPTEGLSPSRVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEETTNSRFPIPLEKLFTGPSSAFVVQPQNGRCTTDGVLLGTTQLSPVNICTFRGDVTHIAGSRNYTMNLASLNWNNYVPTEEIPAPLGTPDFVGKVQGMLTQTTKGDGSTRGHKATVYTGSAPFTPKLGSVQFETDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3722 - protein, 538 aa, Artificial Sequence
  VP1__Norovirus_and/or_Norovirus-like__AB541310
MKMRSSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTGSCRVLTRPSPDFDFIFLVPPTVESRTKPFSVSFFTGEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGDTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3723 - protein, 538 aa, Artificial Sequence
  VP1__Norovirus_and/or_Norovirus-like__EF535854
MKMATNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVEVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSALVVQPQNGRCTTDGVLLGTTQLSPVNICTFRGDVTHISGTRTYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSSAHRNEPQQWVLPDYSGRTVHNVHLAPAVAPTFPGEQLPFFRSTMPGCSGYPNMDLDCLLPQEWVQHFYQEAAPSQSDVALLRFVNPDTGRVLFECKLHKAGYVTVAHTGQHDLVIPPNGYFRFDSWVNQSYTLAPMGNGAGRRR

SEQ ID NO: 3724 - protein, 538 aa, Artificial Sequence
  VP1__Norovirus_and/or_Norovirus-like__KX514368
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHPGNSKIYTMNLASPNWNNYDPTEEIPAPLGTPDFVGKIQGMLTQTTKGEGSTRGHRATVYVGSANYAPKLGRVQFETDTTDDLDAHQNTKFTPVGVVQGGESPKGSEPQQWVLPSYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3725 - protein, 538 aa, Artificial Sequence
  VP1__Norovirus_and/or_Norovirus-like__KX514351
MKMASNDANPSDGSTANLVPEVNNEVMALEPVVGAAIAAPVAGQQNVIDPWIRNNFVQAPGGEFTVSPRNAPGEILWSAPLGPGLNPYLSHLARMYNGYAGGFEVQVILAGNAFTAGKIIFAAVPPNFPTEGLNPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVQEMTNSRFPATLDKLFTGPSSNLVVQPQNGRCMIDGVLLGTTQLSPVNICTFRGDVTHLRDSTIYTMNLASPNWNNYDPTEEIPAPLGTPDFVGKIQGVLTQTTKGEGSTRGHRATVYVGSANYTPKLGKVQFETNTTNDLYAHQNTKFTPVGVVQGGESAHRSEPQQWVLPGFSGRDTPNVHLAPAVAPTFPGEQLLFFRSTIPGCGGHPNMDLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3726 - protein, 538 aa, Artificial Sequence
  VP1__Norovirus_and/or_Norovirus-like__KC517372
MKMASNDANPSDGSAVNLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDARQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVAHIAGSRNYTMNLASLNWNNYDPTEEIPAPLGTPDFVGKIQGMLTQTTKGDGSTRGHKATVYTGSAPFTPKLGSVQFETDTENDFETHQNTKFTPVGVIQDGGTTHRNEPQQWVLPSYSGRNVPNVHLAPAVAPTFPGEQLLLFRSTMPGCSGYPNMDLDCLLPQEWVQHFYQEAAPAQSDVALLRFVNPDTGRVLFECKLHKSGYVTVAHTGQHDLVIPPSGYFRFDSWVNQFYTLAPMGNGTGRRR

SEQ ID NO: 3727 - protein, 538 aa, Artificial Sequence
  VP1__Norovirus_and/or_Norovirus-like__JN400613
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFRGRSSALVVHPQNGRCTTDGVLLGTTQLSPVNICTFRGDVTHIAGSHNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGGNVHNVHLAPAVAPTFPGEQLLFFRSTMPGCSGYPNMDLDCLLPQEWVQHFYQEAAPAQSDVALLRFVNPDTGRVLFEYKLHKSDYVTVAHTGQHDLVIPPNGYFRFDSWVNQFYTLAAMGNGTGRRR

SEQ ID NO: 3728 - protein, 538 aa, Artificial Sequence
  VP1__Norovirus_and/or_Norovirus-like__KX514291
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHPRDSPIYTMNLASPNWNNYDPTEEIPAPLGTPDFTGKIQGMLTQTTKGEGSTRGHRATVYVGSANYAPKLGRVQFETDTTNDLDAHQNTKFTPVGVIQGGESAHRSEPQQWVLPSYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3729 - protein, 538 aa, Artificial Sequence
  VP1__Norovirus_and/or_Norovirus-like__KX514219
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHPRDSPIYTMNLASPNWNNYDPTEEIPAPLGTPDFVGKIQGMLTQTTKGEGSTRGHRATVYVGSANYAPKLGRVQFETDTTNDLDAHQNTKFTPVGVVQGGESPQRSEPQQWVLPSYSGRDTPNVHLAPAVAPTFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3730 - protein, 538 aa, Artificial Sequence
  VP1__Norovirus_and/or_Norovirus-like__AB933668
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTVVKTTLSAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3731 - protein, 538 aa, Artificial Sequence
  VP1__Norovirus_and/or_Norovirus-like__KJ678149
MKMASSDANPSDGSAANLVPEVNNEVMALEPVVGAAIAAPVAGQQNVIDPWIRNNFVQAPGGEFTISPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDSTIKLIAMLYTPLRANNAGDDVFTVSCRVLTRPSPDFDLIFLVPPTVESRTKPFSVPVLTVEEMTNSRFPTPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFETNQNTKFTPVGVIQDGSTTHRNEPQQWVLPSYSGRNTPNVHLAPAVAPTFPGEQLLFFRSTIPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3732 - protein, 538 aa, Artificial Sequence
  VP1__Norovirus_and/or_Norovirus-like__KP244318
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNIRTFRGDVTHIPGSRNYTMNSASQNWNSYDPTEEIPAPLGTPDFVGKIQGVLTQTTRANGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3733 - protein, 538 aa, Artificial Sequence
  VP1__Norovirus_and/or_Norovirus-like__KX514362
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHPGGSKIYTMNLASPNWNNYDPTEEIPAPLGTPDFVGKIQGMLTQTTKGEGSTRGHRATVYVGSANYAPKLGRVQFETDTTDDLDAHQNTKFTPVGVVQGGESPKGSEPQQWVLPSYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3734 - protein, 538 aa, Artificial Sequence
  VP1__Norovirus_and/or_Norovirus-like__KX514329
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHSGNSKIYTMNLASPNWNNYDPTEEIPAPLGTPDFVGKIQGMLTQTTKGEGSTRGHRATVYVGSANYAPKLGRVQFETDTTDDLDAHQNTKFTPVGVVQGGESPKGSEPQQWVLPSYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3735 - protein, 538 aa, Artificial Sequence
  VP1__Norovirus_and/or_Norovirus-like__KJ678152
MKMASSDANPCDGSAANLVPEVNNEVMALEPVVGAAIAAPVGGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPTPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYIGSADFAPKLGRVQFETDTDHDFETNQNTKFTPVGVIQDGSTTHRNEPQQWVLPSYSGRNTPNVHLAPAVAPTFPGEQLLFFRSTLPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3736 - protein, 538 aa, Artificial Sequence
  VP1__Norovirus_and/or_Norovirus-like__KX514352
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHPRDSPIYTMNLASPNWNNYDPTEEIPAPLGTPDFVGKIQGMLTQTTKGEGSTRGHRATVYVGSANYAPKLGRVQFETDTTNDLYAHQNTKFTPVGVVQGGESAHRSEPQQWVLPGYSGRDTPNVHLAPAVAPTFPGEQLLFFRSTIPGCGGHPNMDLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3737 - protein, 538 aa, Artificial Sequence
  VP1__Norovirus_and/or_Norovirus-like__KX514339
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTQSGNTKIYTMNLASPNWNNYDPTEEIPAPLGTPDFVGKIQGMLTQTTKGEGSTRGHRATVYVGSANYAPKLGRVQFETDTTDDLDAHQNTKFTPVGVVQGGESPKGSEPQQWVLPSYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRRR

SEQ ID NO: 3738 - protein, 538 aa, Artificial Sequence
  VP1__Norovirus_and/or_Norovirus-like__KR904238
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLPFFRSTMPGCSGYPNMDLDCLLPQEWVQYFYQEAAPAQSDVALLRFVNPDTGRVLFECKLHKSGYVTVAHTGQHDLVIPPYGYFRFDSWVNQFYTLAPMGNGTGRRR

SEQ ID NO: 3739 - protein, 538 aa, Artificial Sequence
  VP1__Norovirus_and/or_Norovirus-like__KJ710245
MKMASSDANPSDGSTANLVPEVNDEVMALEPVVGAALAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIIVDVRQLEPVLIPLPDARNNFYHYNQSNESTIKLIAMLYTPLRANNAGDDVFTVSCRVLTRPSLDFDFIFLVPPTVESRTKPFSVPILTVEEMTNSRFPIPLERLFTGPSSAFAVQPQNGRCTTDGVLLGTTQLSPVNICTFRGDVTHTTGSHNYTMNLASQNRSNYDPTEEIPAPLGTPDFVGKIQGALTQTTRADGSTRGHKATVYTGSADFTPKLGRVQFATDTDHDFDTNQNTKFTPVGVIQDGSTTHRNEPQQWVLPSYSGRNTHNVHLAPAVAPTFPGEQLLFFRSTMPGCSGYPNMDLDCLLPQEWVAHFYQEAAPAQSDVALLRFVNPDTGRVLFECKLHKSGYVTVAHTGQHDLVIPPNGYFRFDSWVNQFYTLAPMGNGTGRRR

SEQ ID NO: 3740 - protein, 538 aa, Artificial Sequence
  VP1__Norovirus_and/or_Norovirus-like__KX514298
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHPRDSPIYTMNLASPNWNNYDPTEEIPAPLGTPDFVGKIQGMLTQTTKGEGSTRGHRATVYVGSANYAPKLGRVQFETDTTNDLDAHQNTKFTPVGVIQGGESAHRSEPQQWVLPSYSGRDIPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3741 - protein, 538 aa, Artificial Sequence
  VP1__Norovirus_and/or_Norovirus-like__KX514269
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHPRDSPIYTMNLASPNWNNYDPTEEIPAPLGTPDFTGKIQGMLTQTTKGEGSTRGHRATVYVGSANYAPKLGRVQFETDTTNDLDAHQNTKFTPVGVVQSGESPKGSEPQQWVLPSYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3742 - protein, 538 aa, Artificial Sequence
  VP1__Norovirus_and/or_Norovirus-like__KX514179
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHPRDSQIYTMNLASPNWNNYDPTEEIPAPLGTPDFVGKIQGMLTQTTKGEGSTRGHRATVYVGSANYAPKLGRVQFETDTTNDLDAHQNTKFTPVGVVQGGESPKGSEPQQWVLPSYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3743 - protein, 538 aa, Artificial Sequence
  VP1__Norovirus_and/or_Norovirus-like__KX514289
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHPRDSPIYTMNLASPNWNNYDPTEEIPAPLGTPDFVGKIQGMLTQTTKGEGSTRGHRATVYVGSANYAPKLGRVQFETDTTNDLDAHQNTKFTPVGVVQSGESPKGSEPQQWVLPSYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3744 - protein, 538 aa, Artificial Sequence
  VP1__Norovirus_and/or_Norovirus-like__KX514288
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHPRDSPIYTMNLASPNWNNYDPTEEIPAPLGTPDFVGKIQGMLTQTTKGEGSTRGHRATVYVGSANYAPKLGRVQFETDTTNDLDAHQNTKFTPVGVVQSGESPKGSEPQQWVLPSYSGRDTPNVHLAPAVAPTFPGEQLLFFRSTIPGCGGHPNMDLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3745 - protein, 538 aa, Artificial Sequence
  VP1__Norovirus_and/or_Norovirus-like__KX514268
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHPRDSPIYTMNLASPNWNNYDPTEEIPAPLGTPDFVGKIHGMLTQTTKGEGSTRGHRATVYVGSANYAPKLGRVQFETDTTNDLDAHQNTKFTPVGVVQGGESPKGSEPQQWVLPSYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3746 - protein, 538 aa, Artificial Sequence
  VP1__Norovirus_and/or_Norovirus-like__JX459653
MKMASSDPNPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSKLKLRPMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3747 - protein, 538 aa, Artificial Sequence
  VP1__Norovirus_and/or_Norovirus-like__KX514359
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHPRDSPIYTMNLASPNWNNYDPTEEIPAPLGTPDFVGKIQGMLTQTTKGEGSTRGHRATVYVGSANYAPKLGRVQFETDTTNDLDAHQNTKFTPVGVVQGGESPQRSEPQQWVLPSYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3748 - protein, 538 aa, Artificial Sequence
  VP1__Norovirus_and/or_Norovirus-like__KX514296
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHPRDSPIYTMNLASPNWNNYDPTEEIPAPLGTPDFVGKIQGMLTQTTKGEGSTRGHRATVYVGSANYAPKLGRVQFETGTTNDLDAHQNTKFTPVGVVQGGESPQGSEPQQWVLPSYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3749 - protein, 538 aa, Artificial Sequence
  VP1__Norovirus_and/or_Norovirus-like__KX514284
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHPRDSPIYTMNLASPNWNNYDPTEEIPAPLGTPDFVGKIQGMLTQTTKGEGSTRGHRATVYVGSANYAPKLGRVQFETDTTNDLDAHQNTKFTPVGVVQGGESPQRSEPQQWVLPSYSGRDTPNVHLAPAVAPTFPGEQLLFFRSTIPGCGGHPNMDLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3750 - protein, 538 aa, Artificial Sequence
  VP1__Norovirus_and/or_Norovirus-like__KX514245
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHPRDSPIYTMNLASPNWNNYDPTEEIPAPLGTPDFVGKIQGMLTQTTKGEGSTRGHRATVYVGSANYAPKLGRVQFETDTTNDLDAHQNTKFTPVGVVQGGESPQRSEPQQWVLPSYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVTHTGQHDLVIPPNGYFRFDSWVNQFYTLAPMGNGTGRKR

SEQ ID NO: 3751 - protein, 538 aa, Artificial Sequence
  VP1__Norovirus_and/or_Norovirus-like__KX514327
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHSGNSKIYTMNLASPNWNNYDPTEEIPAPLGTPDFVGKIQGMLTQTTKGEGSTRGHRATVYVGSANYAPKLGRVQFETDTTDDLDAHQNTKFTPVGVVQGGESPKGSEPQQWVLPSYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3752 - protein, 538 aa, Artificial Sequence
  VP1__Norovirus_and/or_Norovirus-like__KX514301
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHPRDSPIYTMNLASPNWNNYDPTEEIPAPLGTPDFVGKIQGMLTQTTKGEGSTRGHRATVYVGSANYAPKLGRVQFETDTTNDLDAHQNTKFTPVGVVQGGESPKGSEPQQWVLPSYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3753 - protein, 538 aa, Artificial Sequence
  VP1__Norovirus_and/or_Norovirus-like__KX514299
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHPRDSPIYTMNLASPNWNNYDPTEEIPAPLGTPDFVGKIQGMLTQTTKGEGSTRGHRATVYVGSANYAPKLGRVQFETDTTNDLDAHQNTKFTPVGVVQGGESPQGSEPQQWVLPSYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3754 - protein, 538 aa, Artificial Sequence
  VP1__Norovirus_and/or_Norovirus-like__KX514277
MKMASNDANPSDGSAANLVPEVNNEVMALEPVVGAAIAAPVAGQQNVIDPWIRNNFVQAPGGEFTVSPRNAPGEILWSAPLGPELNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHPRDSPIYTMNLASPNWNNYDPTEEIPAPLGTPDFVGKIQGMLTQTTKGEGSTRGHRATVYVGSANYAPKLGRVQFETDTTNDLDAHQNTKFTPVGVVQGGESPKGSEPQQWVLPSYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3755 - protein, 538 aa, Artificial Sequence
  VP1__Norovirus_and/or_Norovirus-like__KX514213
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVQEMTNSRFPATLDKLFTGPSSNLVVQPQNGRCMIDGVLLGTTQLSPVNICTFRGDVTHPRDSPIYTMNLASPNWNNYDPTEEIPAPLGTPDFVGKIQGMLTQTTKGEGSTRGHRATVYVGSANYAPKLGRVQFETDTTNDLDAHQNTKFTPVGVVQGGESPQRSEPQQWVLPSYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3756 - protein, 538 aa, Artificial Sequence
  VP1__Norovirus_and/or_Norovirus-like__KT033903
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGGDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKVQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTVRVLFECKLHKSGYVTVAHTGQHDLVIPPNGYFRFDSWVNQFYTLAPMGNGTGRRR

SEQ ID NO: 3757 - protein, 538 aa, Artificial Sequence
  VP1__Norovirus_and/or_Norovirus-like__HM625866
MKMASSDANPSDGSTANLVPEVNNEVMALEPVVGAASAAPVAGQQNVIDPWIRNNFVQAPGGEFTESPTNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPATVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPVGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3758 - protein, 538 aa, Artificial Sequence
  VP1__Norovirus_and/or_Norovirus-like__KX514319
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHPGGSKIYTMNLASPNWNNYDPTEEIPAPLGTPDFVGKIQGMLTQTTKGEGSTRGHRATVYVGSANYAPKLGRVQFETDTTDDLDAHQNTKFTPVGVVQGGESPKGSEPQQWVLPSYSGRDTPNVHLAPAVAPTFPGEQLLFFRSTIPGCGGHPNMDLDCLLPQEWVQHFYQEAAPAQSDVALLRFVNPDTSRVLFECKLHKSGYVTVAHTGQHDLVIPPNGYFRFDSWVNQFYTLAPMGNGTGRRR

SEQ ID NO: 3759 - protein, 538 aa, Artificial Sequence
  VP1__Norovirus_and/or_Norovirus-like__KX514311
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLERLFTGPSSANVVQPQNGRCMIDGVLLGTTQLSPVNICTFRGDVTHPGGSKIYTMNLASPNWNNYDPTEEIPAPLGTPDFVGKIQGMLTQTTKGEGSTRGHRATVYVGSANYAPKLGRVQFETDTTDDLDAHQNTKFTPVGVVQGGESPKGSEPQQWVLPSYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3760 - protein, 538 aa, Artificial Sequence
  VP1__Norovirus_and/or_Norovirus-like__KX514266
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHPGDSPIYTMNLASPNWNNYDPTEEIPAPLGTPDFVGKIQGMLTQTTKGEGSTRGHRATVYVGSANYAPKLGRVQFETDTTNDLDAHQNTKFTPVGVVQGGESPKGSEPQQWVLPSYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3761 - protein, 538 aa, Artificial Sequence
  VP1__Norovirus_and/or_Norovirus-like__KX514235
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSSDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHPRDSPIYTMNLASPNWNNYDPTEEIPAPLGTPDFVGKIQGMLTQTTKGEGSTRGHRATVYVGSANYAPKLGRVQFETDTTNDLDAHQNTKFTPVGVVQGGESPQRSEPQQWVLPSYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3762 - protein, 538 aa, Artificial Sequence
  VP1__Norovirus_and/or_Norovirus-like__KX354115
MKMASSDANPSDGSAANLVPEANNEVMALEPVAGAALAAPVAGQQNVIDPWIRNNFVQAPGGEFTISPRNAPGEILWSAPLGPDLNPYLSHLARMYNGYAGGFEVQVILAGNAFTAGKVIFAAVPPNFPTSGLSPSQVTMFPSVVVDVRQLEPVLIPLPDVRNNFYHYNQSNDPTITLIAMLYTPLRANNAGDDVFTVSCRVLTRPSPDFDFIFLVPPTVESRTKPFSVPVLTVEEMTNSRFPIPLERLFTGPSSAFVVQPQNGRCTTDGVLLGTTQLSPVNICTFRGDIIHITGSHNYTMNLASQNWNNYDPTEEIPAPLGTPDFVGKIQGVLTQTTRGDGSTRGHKATVYTGSADFIPKLGRVQFETDTNHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYITVAHTGQHDLVIPPNGYFRFDSWVNQFYTLAPMGNGTGRRR

SEQ ID NO: 3763 - protein, 538 aa, Artificial Sequence
  VP1__Norovirus_and/or_Norovirus-like__KM272334
MKMASSDANPSDGSAANLVPEVNNEVMALEPVVGAAIAAPVAGQQNVIDPWIRNNFVQAPGGEFTVSPRNAPGEILWSAPLGPDLNPYLSHLARTYNGYAGGFEVQVILAGNAFTAGKVIFAAVPPNFPTEGLSPSQVTMFPHIVVDARQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNSRCTTDGVLLGTTQLSPVNICTFRGDVTHITGSRNYTMNLASQNWNNYDPTEEIPVPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQGAAPAQSDVALLRFVNPDTGRVLFECKLHKSGYVTVAHTGQHDLVIPPNGYFRFDSWVNQFYTLAPMGNGTGRRR

SEQ ID NO: 3764 - protein, 538 aa, Artificial Sequence
  VP1__Norovirus_and/or_Norovirus-like__KX354116
MKMASSDANPSDGSAANLVPEANNEVMALEPVAGAALAAPVAGQQNVIDPWIRNNFVQAPGGEFTISPRNAPGEILWSAPLGPDLNPYLSHLARMYNGYAGGFEVQVILAGNAFTAGKVIFAAVPPNFPTAGLSPSQVTMFPSVVVDVRQLEPVLIPLPDVRNNFYHYNQSNDPTITLIAMLYTPLRANNAGDDVFTVSCRVLTRPSPDFDFIFLVPPTVESRTKPFSVPVLTVEEMTNSRFPIPLERLFTGPSSAFVVQPQNGRCTTDGVLLGTTQLSPVNICTFRGDIIHITGSHNYTMNLASQNWNNYDPTEEIPAPLGTPDFVGKIQGVLTQTTRGDGSTRGHKATVYTGSADFIPKLGRVQFETDTNHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYITVAHTGQHDLVIPPNGYFRFDSWVNQFYTLAPMGNGTGRRR

SEQ ID NO: 3765 - protein, 538 aa, Artificial Sequence
  VP1__Norovirus_and/or_Norovirus-like__KX514172
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHPRDSQIYTMNLASPNWNNYDPTEEIPAPLGTPDFVGKIQGMLTQTTKGEGSTRGHRATVYVGSANYAPKLGRVQFETDTTNDLDAHQNTKFTPVGVVQGGESPKGSEPQQWVLPSYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3766 - protein, 538 aa, Artificial Sequence
  VP1__Norovirus_and/or_Norovirus-like__KX354114
MKMASSDANPSDGSAANLVPEANNEVMALEPVAGAALAAPVAGQQNVIDPWIRNNFVQAPGGEFTISPRNAPGEILWSAPLGPDLNPYLSHLARMYNGYAGGFEVQVILAGNAFTAGKVIFAAVPPNFPTSGLSPSQVTMFPSVVVDVRQLEPVLIPLPDVRNNFYHYNQSNDPTITLIAMLYTPLRANNAGDDVFTVSCRVLTRPSPDFDFIFLVPPTVESRTKPFSVPVLTVEEMTNSRFPIPLERLFTGPSSAFVVQPQNGRCTTDGVLLGTTQLSPVNICTFRGDIIHITGSHNYTMNLASQNWNNYDPTEEIPAPLGTPDFVGKIQGVLTQTTRGDGSTRGHKATVYTGSADFIPKLGRVQFETDTNHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYITVAHTGQHDLVIPPNGYFRFDSWVNQFYTLAPMGNGTGRKR

SEQ ID NO: 3767 - protein, 538 aa, Artificial Sequence
  VP1__Norovirus_and/or_Norovirus-like__KX514295
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLNPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHPRDSPIYTMNLASPNWNNYDPTEEIPAPLGTPDFVGKIQGMLTQTTKGEGSTRGHRATVYVGSANYAPKLGRVQFETDTTNDLDAHQNTKFTPVGVVQGGESPKGSEPQQWVLPSYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3768 - protein, 538 aa, Artificial Sequence
  VP1__Norovirus_and/or_Norovirus-like__KX514242
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHPRDSPIYTMNLASPNWNNYDPTEEIPAPLGTPDFVGKIQGMLTQTTKGEGSTRGHRATVYVGSANYAPKLGRVQFETDTTNDLDAHQNTKFTPVGVVQGGESPQRSEPQQWVLPSYSGRDTPNVHLAPAVAPTFPGEQLLFFRSTIPGCGGHPNMDLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3769 - protein, 538 aa, Artificial Sequence
  VP1__Norovirus_and/or_Norovirus-like__KX514224
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNVFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHPRDSPIYTMNLASPNWNNYDPTEEIPAPLGTPDFVGKIQGMLTQTTKGEGSTRGHRATVYVGSANYAPKLGRVQFETDTTNDLDAHQNTKFTPVGVVQGGESPQRSEPQQWVLPSYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3770 - protein, 538 aa, Artificial Sequence
  VP1__Norovirus_and/or_Norovirus-like__KX514262
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSAFVVQPQNGRCMIDGVLLGTTQLSPVNICTFRGDVTHPRDSPIYTMNLASPNWNNYDPTEEIPAPLGTPDFVGKIQGMLTQTTKGEGSTRGHRATVYVGSANYAPKLGRVQFETDTTNDLDAHQNTKFTPVGVVQGGESPKGSEPQQWVLPSYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3771 - protein, 538 aa, Artificial Sequence
  VP1__Norovirus_and/or_Norovirus-like__KX354139
MKMASSDANPSDGSAANLVPEANNEVMALEPVAGAALAAPVAGQQNVIDPWIRNNFVQAPGGEFTISPRNAPGEILWSAPLGPDLNPYLSHLARMYNGYAGGFEVQVILAGNAFTAGKVIFAAVPPNFPTTGLSPSQVTMFPSVVVDVRQLEPVMIPLPDVRNNFYHYNQSNDPTITLIAMLYTPLRANNAGDDVFTVSCRVLTRPSPDFDFIFLVPPTVESRTKPFSVPVLTVEEMTNSRFPIPLERLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQVIFIRSTMPGSSGYPNMDLDCLLPQEWVQYFYQEAAPAQSDVAMIRFVNPDTGRVLFECKLHKSGYITVAHTGQHDLVIPPNGYFRFDSWVNQFYTLAPMGNGTGRRR

SEQ ID NO: 3772 - protein, 538 aa, Artificial Sequence
  VP1__Norovirus_and/or_Norovirus-like__KX514215
MKMASNDVNPSDGSTANLVPEVNNEVMALEPVVGAAIAAPVAGQQNVIDPWIRNNFVQAPGGEFTVSPRNAPGEILWSAPLGPGLNPYLSHLARMYNGYAGGFEVQVILAGNAFTAGKIIFAAVPPNFPTEGLNPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVQEMTNSRFPATLDKLFTGPSSTFVVQPQNGRCMIDGVLLGTTQLSPVNICTFRGDVTHPRDSPIYTMNLASPNWNNYDPTEEIPAPLGTPDFVGKIQGMLTQTTKGEGSTRGHRATVYVGSANYAPKLGRVQFETDTTNDLDAHQNTKFTPVGVVQGGESPQRSEPQQWVLPSYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3773 - protein, 538 aa, Artificial Sequence
  VP1__Norovirus_and/or_Norovirus-like__KX514367
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHPRDSPIYTMNLASPNWNNYDPTEEIPAPLGTPDFVGKIQGMLTQTTKGEGSTRGHRATVYVGSADYAPKLGRVQFETDTTNDLDAHQNTKFTPVGVVQGGESPKGSEPQQWVLPSHSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3774 - protein, 538 aa, Artificial Sequence
  VP1__Norovirus_and/or_Norovirus-like__KX514243
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSNLVVQPQNGRCMIDGVLLGTTQLSPVNICTFRGDVTHPRDSPIYTMNLASPNWNSYDPTEETPAPLGTPDFVGKIHGMLTQTTQGSGSTRAHRATVYVGGAEFTPKLGKVQFKTETDHDLSIRQNTKFTPVGVVQGGESPQRSEPQQWVLPSYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3775 - protein, 538 aa, Artificial Sequence
  VP1__Norovirus_and/or_Norovirus-like__KX353996
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNTHNVHLAPAVAPTFPGEQLLFFRSTMPGCSGYPNMDLDRLPPQERVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3776 - protein, 538 aa, Artificial Sequence
  VP1__Norovirus_and/or_Norovirus-like__DQ078820
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLGPSQVTMFPHIIVDVRQLEPVLIPLLDVRNNLYHYNQSNDPTIKLIAMLYTPLRANNAGEVVFTVSCRVLTRPSPDFDFIFLVPPTVESRTKPFTVPILTAEEMTNSRFPTPLGKLFTGPSSAFVVQPQNGRCATDGVLLGTTQLSPVNICTFRGDVTHIAGTHDYTMNLASQNWNNYDPTEEIPAPLGTPDFVGKIQGVLTQTTRGDGSTRGHKATVSTGSVHFTPKLGGVQFTTDTNNDFETGQNTKFTPVGVIQDGNSTHQNEPQQWVLPNYSGRTGHNVHLAPAVAPTFPGEQLLFFRSTMPGCSGYPNMNLDCLLPQEWVQHFYQEAAPAQSDVALLRFVNPDAGRVLFECKPHKSGYVTVAHTGQHDLVIPPNGYFRFDSWVNQFCTLAPMGNGTGRRR

SEQ ID NO: 3777 - protein, 538 aa, Artificial Sequence
  VP1__Norovirus_and/or_Norovirus-like__AB933738
MKMASNDANPSDGSTANLVPEVNNEVMALEPVVGAAIAAPVAGQQNVIDPWIRNNFVQAPGGEFTVSPRNAPGEILWSAPLGPDLNPYLFPLARKVKGYAGGFEVQVILAGKAFPAGKIIFAASPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFSVPILTVEEMTNSRFPIPLEKLFTGPSSTFVVQPQNGRCTTDGVLLGTTQLSPVNICTFRGDVTHIAGSRNYTMNLASQNWNSYDPTEEIPAPLGTPDFVGKIQGVLTQTTRRDGSTRGHKATVYTGSADFSPKLGRVQFATDTDNDFDTHQNTKFTPVGVIQDGGTAHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3778 - protein, 538 aa, Artificial Sequence
  VP1__Norovirus_and/or_Norovirus-like__EU780734
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSIHFTQSWAVFNSPLIQAMTLKLAKTRDSPQSVVVQDGSTTHQNEPQQWVLPDYSGRDSYNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRR

SEQ ID NO: 3779 - protein, 538 aa, Artificial Sequence
  VP1__Norovirus_and/or_Norovirus-like__KP064096
MASKDAPTNMDGTSGAGQLVPEANTAEPISMEPVAGAVTAAATAGQVNMIDPWIMNNYVQAPQGEFTISPNNTPGDILFDLQLGPHLNPFLSHLAQMYNGWVGNMKVRVLLAGNAFTAGKIIISCIPPGFVAQNISIAQATMFPHVIADVRVLEPIEVPLEDVRNVLFHNNDNTPTMRLVCILYTPLRASGSSSGTDPFVIAGRVLTCPSPDFSFLFLVPPNVEQKTKPFSVPNLPLNTLSNSRVPSLIKSMMVSRDHGQMVQFQNGRVTLDGQLQGTTPTSASQLCKIRGSVFHANGGNGYNLTELDGSPYHAFESPAPIGFPDLGECDWHMEASPTTQFNTGDVIKQINVKQESAFAPHLGTIQADGLSDVSVNTNMIAKLGWVSPVSDGHKRDVDPWVIPRYGSTLTEAAQLAPPIYPPGFGEAIVFFMSDFPIAHGTNGLSVPCTIPQEFVTHFVNEQAPTRGEAALLHYLDPDTHRNLGEFKLYPDGFMTCVPNTSGTGPQTLPINGVFVFVSWVSRFYQLKPVGTAGPARRL

SEQ ID NO: 3780 - protein, 538 aa, Artificial Sequence
  VP1__Norovirus_and/or_Norovirus-like__KC473548
MMMASKDAPTNMDGTSGAGQLVPEANTAEPLPIKPVAGAATAVATAGQVNMIDPWIMNNFVQAPQGEFTISPNNTPGDILFDLQLGPHLNPFLAHLSRMYNGWVGNMQVRIMLAGNAFSAGKIIVCCIPPGFSSQSISIAQATMFPHVIADVRVLEPIDVPLDDVRNVLFHNNDNPQTMRLLCMLYTPLRSGGTSSGTDPFVIAGRVLTCPTPDFSFLFLVPPDIEQRTKPFSVPNIPMNLMSNSRVSMLIDGMMVSNDQNQVPQFQNGRVTLDGQLQGTTTVSAACVARMRGRIFNNNGNYGVNLTELDGNPYHAFDSPAPLGFPDFGNCDLHMTFVKINPNELSSGDPSGKVVIRSYDATFAPHLGTVKLENDDELARFVGKEVVLELTWVSNREGATLNLWAVPNYGSSLTQASQLAPPIYPPGFGEAIVYFTSTFPTVSNPKVPCTLPQEFVSHFVNEQAPTRGDAALLHYVDPDTHRNLGEFKMYPEGYMTCVPNAGGGPQTLPINGVFVFISWVSRYYQLKPVGTAGAARRL

SEQ ID NO: 3781 - protein, 538 aa, Artificial Sequence
  VP1__Norovirus_and/or_Norovirus-like__AB684698
MASKDAPSNMDGTSGAGQLVPEANTAEPINMESVVGAATATATAGQVNLIDPWIMNNYVQAPQGEFTISPNNTPGDVLFDLQLGPHLNPFLSHLSRMYNGWVGNMKVRVMLAGNAFSAGKIIICCIPPGFTSQSISIAQATMFPHVIADVRVLEPIDVPLDDVRNVLFHNNDNAQTMRLLCMLYTPLRTGASSSGSDPFVIAGRVLTCPTQDFNFLFLVPPDVEQKTKPFSVPNIPLNLMSNSRVPALIDGMTVSSDQNQVVQFQNGRVTLDGQLQGTTAVSASCVAKIRGRIFSNASHYGINLTEVDGTQYHAFDSPAPLGFPDFGNCDWHVTGTKASQGDLQTDNPTISGTIKSYESSFAPHLGTVRIEGDDNELARFNGKDVLLNLTWFSQRNGSQLNLWTIPSYGSNLTEASQLAPPIYPPGFGEAIVYFTSTFPAISRPSVPCTMPQEFVSHFVNEQAPTRGEAALLHYLDPDTHRNLGEFKMYPEGFFTCVPNAGGSGPQTLPINGVFVFVSWVSRYYQLKPVGTVGMTRRL

SEQ ID NO: 3782 - protein, 538 aa, Artificial Sequence
  VP1__Norovirus_and/or_Norovirus-like__AF538679
MKMASKDAPTNMDGTSGAGQLVPGANTAEPLPIKPVAGAATAVATAGQVNMIDPWIMNNFVQAPQGEFTISPNNTPGDILFDLQLGPHLNPFLAHLSRMYNGWVGNMQVRIMLAGNAFSAGKIIVCCIPPGFSSQSISIAQATMFPHVIADVRVLEPIDVPLDDVRNVLFHNNDNPQTMRLLCMLYTPLRSGGASSGTDPFVIAGRVLTCPTPDFSFLFLVPPDIEQRTKPFSVPNIPMNLMSNSRVPMLIDGMMVSNDQNQVPQFQNGRVTLDGQLQGTTTVSAACIARMRGRIFNNNGNYGVNLAELDGNPYHAFDSPAPLGFPDFGNCDLHMTFVKINPTELSTGDPSGKVVIHSYDATFAPHLGTVKLEDNNELDQFVGKEVVLELTWVSNRTGATLNLWAVPNYGSNLTQASQLAPPIYPPGFGEAIVYFTSTFPTVSNPKVPCTLPQEFVSHFVNEQAPTRGDAALLHYVDPDTHRNLGEFKMYPEGYMTCVPNAGGGPQTLPINGVFVFISWVSRYYQLKPVGTAGAARRL

SEQ ID NO: 3783 - protein, 538 aa, Artificial Sequence
  VP1__Norovirus_and/or_Norovirus-like__JQ743332
MMMASKDASQSADGASGAGQLVPEVNTADPLPMEPVAGPTTAVATAGQVNMIDPWIVNNFVQSPQGEFTISPNNTPGDILFDLQLGPHLNPFLSHLSQMYNGWVGNMRVRILLAGNAFSAGKIIVCCVPPGFTSSSLTIAQATLFPHVIADVRTLEPIEMPLEDVRNVLYHTNDNQPTMRLVCMLYTPLRTGGGSGNSDSFVVAGRVLTAPSSDFSFLFLVPPTIEQKTRAFTVPNIPLQTLSNSRFPSLIQGMILSPDASQVVQFQNGRCLIDGQLLGTTPATSGQLFRVRGKINQGARTLNLTEVDGKPFMAFDSPAPVGFPDFGKCDWHMRISKTPNNTSSGDPMRSVSVQTNVQGFVPHLGSIQFDEVFNHPTGDYIGTIEWISQPSTPPGTDINLWEIPDYGSSLSQAANLAPPVFPPGFGEALVYFVSAFPGPNNRSAPNDVPCLLPQEYITHFVSEQAPTMGDAALLHYVDPDTNRNLGEFKLYPGGYLTCVPNGVGAGPQQLPLNGVFLFVSWVSRFYQLKPVGTASTAR

SEQ ID NO: 3784 - protein, 538 aa, Artificial Sequence
  VP1__Norovirus_and/or_Norovirus-like__GQ856470
MMMASKDAPTNMDGTSGAGQLVPEVSTAEPISMEPVAGAATAAATAGQVNMIDPWIMSNYVQAPQGEFTISPNNTPGDILFDLQLGPHLNPFLSHLAQMYNGWVGNMKVRVLLAGNAFTAGKIIISCVPPGFAAQNVSIAQATMFPHVIADVRVLEPIEVPLEDVRNVLFHNNDSTPTMRLICMLYTPLRASGSSSGTDPFVIAGRVLTCPSPDFNFLFLVPPNVEQKTKPFSVPDLPLNVLSNSRVPSLIKSMMVSQDHGQMVQFQNGRVTLDGQLQGTTPTSASQLCKIRGTVYHATGGQGLNLTEIDGTPYHAFESPAPIGFPDLGECDWHINASPANAFTDGSIIHRIDVVQDPTFAPHLGTIHYTNANYDANVSLICSLEWLSPPSGGALKANPWAIPRYGSTLTEAAQLAPPIYPPGFGEAIVFFMSDFPIANGSDGLSVPCTIPQEFVTHFVNEQAPTRGEAALLHYVDPDTHRNLGEFKLYPEGFMTCVPNSSGSGPQTLPINGVFTFISWVSRFYQLKPVGTTGPVRRL

SEQ ID NO: 3785 - protein, 538 aa, Artificial Sequence
  VP1__Norovirus_and/or_Norovirus-like__JN603244
MMMASKDAPTNMDGTSGAGQLVPEVSTAEPISMEPVAGAATAAATAGQVNMIDPWIMSNYVQAPQGEFTISPNNTPGDILFDLQLGPHLNPFLSHLAQMYNGWVGNMKVRVLLAGNAFTAGKIIISCVPPGFAAQNVSIAQATMFPHVIADVRVLEPIEVPLEDVRNVLFHNNDSTPTMRLICMLYTPLRASGSSSGTDPFVIAGRVLTCPSPDFNFLFLVPPNVEQKTKPFSVPNLPLNVLSNSRVPSLIKSMMVSQDHGQMVQFQNGRVTLDGQLQGTTPTSASQLCKIRGTVYHATGGQGLNLTEIDGTPYHAFESPAPIGFPDLGECDWHINASPANAFTDGSIIHRIDVAQDSTFAPHLGTIHYTNADYNANVGLICSLEWLSPPSGGAPKVNPWAIPRYGSTLTEAAQLAPPIYPPGFGEAIVFFMSDFPIANGSDGLSVPCTIPQEFVTHFVNEQAPTRGEAALLHYVDPDTHRNLGEFKLYPEGFMTCVPNSSGSGPQTLPINGVFTFISWVSRFYQLKPVGTTGPVRRL

SEQ ID NO: 3786 - protein, 538 aa, Artificial Sequence
  VP1__Norovirus_and/or_Norovirus-like__AB078335
MMMASKDAPQSADGASGAGQLVPEVNTADPLPMEPVAGPTTAVATAGQVNMIDPWIVNNFVQSPQGEFTISPNNTPGDILFDLQLGPHLNPFLSHLSQMYNGWVGNMRVRILLAGNAFSAGKIIVCCVPPGFTSSSLTIAQATLFPHVIADVRTLEPIEMPLEDVRNVLYHTNDNQPTMRLVCMLYTPLRTGGGSGNSDSFVVAGRVLTAPSSDFSFLFLVPPTIEQKTRAFTVPNIPLQTLSNSRFPSLIQGMILSPDASQVVQFQNGRCLIDGQLLGTTPATSGQLFRVRGKINQGARTLNLTEVDGKPFMAFDSPAPVGFPDFGKCDWHMRISKTPNNTSSGDPMRSVSVQTNVQGFVPHLGSIQFDEVFNHPTGDYIGTIEWISQPSTPPGTDINLWEIPDYGSSLSQAANLAPPVFPPGFGEALVYFVSAFPGPNNRSAPNDVPCLLPQEYITHFVSEQAPTMGDAALLHYVDPDTNRNLGEFKLYPGGYLTCVPNGVGAGPQQLPLNGVFLFVSWVSRFYQLKPVGTASTAR

SEQ ID NO: 3787 - protein, 538 aa, Artificial Sequence
  VP1__Norovirus_and/or_Norovirus-like__GU299761
MMMASKDAPTNMDGTSGAGQLVPEANTAEPLPIKPVAGAATAVATAGQVNMIDPWIMNNFVQAPQGEFTISPNNTPGDILFDLQLGPHLNPFLAHLSRMYNGWVGNMQVRIMLAGNAFSAGKIIVCCIPPGFSSQSISIAQATMFPHVIADVRVLEPIDVPLDDVRNVLFHNNDNPQTMRLLCMLYTPLRSGGTSSGTDPFVIAGRVLTCPTPDFSFLFLVPPDIEQRTKPFSVPNIPMNLMSNSRVSMLIDGMMVSNDQNQVPQFQNGRVTLDGQLQGTTTVSAACVARMRGRIFNNNGNYGVNLTELDGNPYHAFDSPAPLGFPDFGNCDLHMTFVKINPNELSSGDPSGKVVIHSYDATFAPHLGTVKLENDDELARFVGKEVVLELTWVSNREGATLNLWAVPNYGSSLTQASQLAPPIYPPGFGEAIVYFTSTFPTVSNPKVPCTLPQEFVSHFVNEQAPTRGDAALLHYVDPDTHRNLGEFKMYPEGYMTCVPNAGGGPQTLPINGVFVFISWVSRYYQLKPVGTAGAARRL

SEQ ID NO: 3788 - protein, 538 aa, Artificial Sequence
  VP1__Norovirus_and/or_Norovirus-like__AJ277610
MMMASKGAPQSADGSSGAGQLVPEVNTADPLPMEPVAGPTTAVATAGQVNMIDPWIVNNFVQSPQGEFTISPNNTPGDILFDLQLGPHLNPFLSHLSQMYNGWVGNMRVRILLAGNAFSAGKIIVCCVPPGFTSSSLTIAQATLFPHVIADVRTLEPIEMPLEDVRNVLYHTNDSQPTMRLVCMLYTPLRTGGGSGNSDSFVVAGRVLTAPSSDFSFLFLVPPTIEQKTRAFTVPNIPLQTLSNSRFPSLIQGMILSPDASQVVQFQNGRCLIDGQLLGTTPATSGQLFRVRGKINQGARTLNLTEVDGKPFMAFDSPAPVGFPDFGKCDWHMRVSKTPNNTSSGDPMRSVSVQTNVQGFVPHLGSIQFDEVFNHPTGDYIGTIEWISQPSTPLGTDINLWEIPDYGSSLSQAANLAPPVFPPGFGEALVYFVSAFPGPNNRSAPNDVPCLLPQEYITHFVSEQAPTMGDAALLHYVDPDTNRNLGEFKLYPGGYLTCVPNGVGAGPQQLPLNGVFLFVSWVSRFYQLKPVGTASTAR

SEQ ID NO: 3789 - protein, 538 aa, Artificial Sequence
  VP1__Norovirus_and/or_Norovirus-like__GQ856462
MMMASKDAPTNMDGTSGAGQLVPEANTAEPLPIKPVAGAATAVATAGQVNMIDPWIMNNFVQAPQGEFTISPNNTPGDILFDLQLGPHLNPFLAHLSRMYNGWVGNMQVRIMLAGNAFSAGKIIVCCIPPGFSSQSISIAQATMFPHVIADVRVLEPIDVPLDDVRNVLFHNNDNPQTMRLLCMLYTPLRSGGTSSGTDPFVIAGRVLTCPTPDFSFLFLVPPDIEQRTKPFSVPNIPMNLMSNSRVSMLIDGMMVSNDQNQVPQFQNGRVTLDGQLQDTTTVSAACVARMRGRIFNNNGNYGVNLTELDGNPYHAFDSPAPLGFPDFGNCDLHMTFVKINPNELSSGDPSGKVVIHSYDATFAPHLGTVKLENDDELARFVGKEVVLELTWVSNREGATLNLWAVPNYGSSLTQASQLAPPIYPPGFGEAIVYFTSTFPTVSNPKVPCTLPQEFVSHFVNEQAPTRGDAALLHYVDPDTHRNLGEFKMYPEGYMTCVPNAGGGPQTLPINGVFVFISWVSRYYQLKPVGTAGAARRL

SEQ ID NO: 3790 - protein, 538 aa, Artificial Sequence
  VP1__Norovirus_and/or_Norovirus-like__AF435807
MKMASKDAPQSADGASGAGQLVPEVNTADPLPMEPVAGPTTAVATAGQVNMTDPWIVNNFVQSPQGEFTISPNNTPGDILFDLQLGPHLNPFLSHLSQMYNGWVGNMRVRILLAGNAFSAGKIIVCCVPPGFTSSSLTIAQATLFPHVIADVRTLEPIEMPLEDVRNVLYHTNDNQPTMRLVCMLYTPLRTGGGSGDSDSFVVAGKVLTAPSSDFSFLFLVPPTIEQKTRAFTVPNIPLQTLSNSRFPSLIQGMILSPDASQVVQFQNGRCLIDGQLLGTTPATSGQLFRVRGKINQGARTLNLTEVDGKPFMAFDSPAPVGFPDFGKCDWHMRISKTPNNTSSGDPMRSVSVQTNVQGFVPHLGSIQFDEVFNHPTGDYIGTIEWISQPSTPPGTDINLWEIPDYGSSLSQAANLAPPVFPPGFGEALVYFVSAFPGPNNRSAPNDVPCLLPQEYITHFVSEQAPTMGDAALLHYVDPDTNRNLGEFKLYPGGYLTCVPNGVGAGPQQLPLNGVFLFVSWVSRFYQLKPVGTASTAR

SEQ ID NO: 3791 - protein, 538 aa, Artificial Sequence
  VP1__Norovirus_and/or_Norovirus-like__KX396056
MMMASKDAPTNMDGTSGAGQLVPEASTAEPISMEPVAGAATAAATAGQVNMIDPWIMSNYVQAPQGEFTISPNNTPGDILFDLQLGPHLNPFLSHLAQMYNGWVGNMKVRVLLAGNAFTAGKIIISCVPPGFAAQNVSIAQATMFPHVIADVRVLEPIEVPLEDVRNVLFHNNDSTPTMRLICMLYTPLRASGSSSGTDPFVIAGRVLTCPSPDFNFLFLVPPNVEQKTKPFSVPNLPLNVLSNSRVPSLIRSMMVSQDHGQMVQFQNGRVTLDGQLQGTTPTSASQLCKIRGTVYHATGGQGLNLTEIDGTPYHALESPAPIGFPDLGECDWHINASPANAFTDGSIIHRIDVAQDSTFAPHLGTIHYTNANYDANISLICSLEWLSPPSGGAPKVNPWAIPRYGSTLTEAAQLAPPIYPPGFGEAIVFFMSDFPIANGSDGLSVPCTIPQEFVTHFVNEQAPTRGEAALLHYVDPDTHRNLGEFKLYPEGFMTCVPNSSGSGPQTLPINGVFTFISWVSRFYQLKPVGTTGPVRRL

SEQ ID NO: 3792 - protein, 538 aa, Artificial Sequence
  VP1__Norovirus_and/or_Norovirus-like__AB187514
MMMASKDAPTNMDGTSGAGQLVPEASTAEPISMEPVAGAATAAATAGQVNMIDPWIMSNYVQAPQGEFTISPNNTPGDILFDLQLGPHLNPFLSHLAQMYNGWVGNMKVRVLLAGNAFTAGKIIISCVPPGFAAQNVSIAQATMFPHVIADVRVLEPIEVPLEDVRNVLFHNNDSTPTMRLICMLYTPLRASGSSSGTDPFVIAGRVLTCPSPDFNFLFLVPPNVEQKTKPFSVPNLPLNVLSNSRVPSLIKSMMVSQDHGQMVHFQIGRVTLDGQLQGTTPTSASQLCKIRGTVYHATGGQGLNLTEIDGTPYHAFESPAPIGFPDLGECDWHINASPANAFTDGSIIHRIDVAQDSTFAPHLGTIHYTNANYDANVSLICSLEWLSPPSGGAPKVNPWAIPRYGSTLTEAAQLAPPIYPPGFGEAIVFFMSDFPIANGSDGLSVPCTIPQEFVTHFVNEQAPTRGEAALLHYVDPDTHRNLGEFKLYPEGFMTCVPNSSGSGPQTLPINGVFTFISWVSRFYQLKPVGTTGPVRRL

SEQ ID NO: 3793 - protein, 538 aa, Artificial Sequence
  VP1__Norovirus_and/or_Norovirus-like__L07418
MMMASKDAPQSADGASGAGQLVPEVNTADPLPMEPVAGPTTAVATAGQVNMIDPWIVNNFVQSPQGEFTISPNNTPGDILFDLQLGPHLNPFLSHLSQMYNGWVGNMRVRILLAGNAFSAGKIIVCCVPPGFTSSSLTIAQATLFPHVIADVRTLEPIEMPLEDVRNVLYHTNDNQPTMRLVCMLYTPLRTGGGSGNSDSFVVAGRVLTAPSSDFSFLFLVPPTIEQKTRAFTVPNIPLQTLSNSRFPSLIQGMILSPDASQVVQFQNGRCLIDGQLLGTTPATSGQLFRVRGKINQGARTLNLTEVDGKPFMAFDSPAPVGFPDFGKCDWHMRISKTPNNTGSGDPMRSVSVQTNVQGFVPHLGSIQFDEVFNHPTGDYIGTIEWISQPSTPPGTDINLWEIPDYGSSLSQAANLAPPVFPPGFGEALVYFVSAFPGPNNRSAPNDVPCLLPQEYITHFVSEQAPTMGDAALLHYVDPDTNRNLGEFKLYPGGYLTCVPNGVGAGPQQLPLNGVFLFVSWVSRFYQLKPVGTASTAR

SEQ ID NO: 3794 - protein, 538 aa, Artificial Sequence
  VP1__Norovirus_and/or_Norovirus-like__FJ515294
MMMASKDAPQSADGASGAGQLVPEVNTADPLPMEPVAGPTTAVATAGQVNMIDPWIVNNFVQSPQGEFTISPNNTPGDILFDLQLGPHLNPFLSHLSQMYNGWVGNMRVRILLAGNAFSAGKIIVCCVPPGFTSSSLTIAQATLFPHVIADVRTLEPIEMPLEDVRNVLYHTNDNQPTMRLVCMLYTPLRTGGGSGNSDSFVVAGRVLTAPSSDFSFLFLVPPTIEQKTRAFTVPNIPLQTLSNSRFPSLIQGMILSPDASQVVQFQNGRCLIDGQLLGTTPATSGQLFRVRGKINQGARTLNLTEVDGKPFMAFDSPAPVGFPDFGKCDWHMRISKTPNNTSSGDPMRSVDVQTDVQGFVPHLGSIQFDEVFNHPTGDYIGTIEWISQPSTPPGTDINLWEIPDYGSSLSQAANLAPPVFPPGFGEALVYFVSAFPGPNNRSAPNDVPCLLPQEYVTHFVSEQAPTMGDAALLHYVDPDTNRNLGEFKLYPGGYLTCVPNGVGAGPQQLPLNGVFLFVSWVSRFYQLKPVGTASTAR

SEQ ID NO: 3795 - protein, 538 aa, Artificial Sequence
  VP1__Norovirus_and/or_Norovirus-like__KJ790198
MRMASDDAKSAPSDLEGAGLVPATAAPLPVAPVAGAQAAEPFAGQINVIDPWIYTNFVQAPTGEFTVSPRNTPGEVLVNLEIGPNLNPYLQHLAQMYNGYAGGVEVQVILAGNAFTAGKLLCALVPPGFPTSSITPAQLTMLPHTIIDVRTTDPVVVPMPDVRRTLWHEVRSTTEPLMRLVIMLYTPMRANSGSDEAFVVSGRVLSRPAPDFNFFYLVPPRVEDTVEPFSLPDLRVDEMSSSRWQNPVVMLQADPNQNIAAHWQNGRCTINGELLGTTPRNQSWLLRMRGSVLAAPGGQKAVTVNVDLTEPDGQAFSVLSGNPGPEGVPDFQAIYNVRMSTASTTAGHTVATNGYIEQSGYTPALGTLVIQGVDLSQVPALGSEVTMQVVSIDLNHNMDPTRLPDYNGAGFDGSVALAPPLVPPLPGEVLLRFTTLPITTSRGSSVSATLDCALPAEWITWFLVHNFVPQGDAALLRYRNRGTGQILFECKLYKEGFLAVAGVSTRTVFPTSGVFEFVSWVPVFYQLTPVGSSGARKR

SEQ ID NO: 3796 - protein, 538 aa, Artificial Sequence
  VP1__Norovirus_and/or_Norovirus-like__KF306212
MMMASKDAPQSADGASGAGQLVPEVNTADPLPMEPVAGPTTAVATAGQVNMIDPWIVNNFVQSPQGEFTISPNNTPGDILFDLQLGPHLNPFLSHLSQMYNGWVGNMRVRILLAGNAFSAGKIIVCFVPPGFTSSSLTIAQATLFPHVIADVRTLEPIEMPLEDVRNVLYHTNDNQPTMRLVCMLYTPLRTGGGSGSSDSFVVAGRVLTAPSSDFSFLFLVPPTIEQKTRAFTVPNIPLQTLSNSRFPSLIQGMILSPDASQVVQFQNGRCLIDGQLLGTTPATSGQLFRVRGKINQGARTLNLTEVDGKPFMAFDSPAPVGFPDFGKCDWHMRISKTPNNTSSGDPMRSVSVQTNVQGFVPHLGSIQFDEVFNHPTGDYIGTIEWISQPSTPPGTDINLWEIPDYGSSLSQAANLAPPVFPPGFGEALVYFVSAFPGPNNRSAPNDVPCLLPQEYITHFVSEQAPTMGDAALLHYVDPDTNRNLGEFKLYPGGYLTCVPNGVGAGPQQLPLNGVFLFVSWVSRFYQLKPVGTASTAR

SEQ ID NO: 3797 - protein, 538 aa, Artificial Sequence
  VP1__Norovirus_and/or_Norovirus-like__KM461694
MKMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVDNISAAQITMCPHVIVDVRQLEPVLLPLPDIRNRFFHYNQEDTPRMRLVAMLYTPLRANSGEDVFTVSCRVLTRPAPDFEFTFLVPPTVESKTKPFTLPILTLGELSNSRFPAAIDMLYTDPNESIVVQPQNGRCTLDGTLQGTTQLVPTQICAFRGTLISQNARAADLTDSPQRARNHPLHVQVKNLDGTQYDPTDDIPAVLGAIDFKGTVFGVASQRDVSGTQEQGHYATRAHEAHIDTTDPKYAPKLGTILIKSESTDFTTNQPIRFTPVGMGDNNWRQWELPDYSGSLTLNMNLAPAVSPSFPGERILFFRSIVPSAGGYGSGYIDCLIPQEWVQHFYQEAAPSQSAVALVRYVNPDTGRNIFEAKLHREGFLTVANSGNNPIVVPPNGYFRFEAWVNQFYTLA

SEQ ID NO: 3798 - protein, 537 aa, Artificial Sequence
  VP1__Norovirus_and/or_Norovirus-like__AB039780
MKMASNDAAPSNDGAAGLVPEINHEVMAIEPVAGASLAAPVVGQLNIIDPWIRNNFVQAPAGEFTVSPRNAPGEFLLDLELGPELNPYLAHLARMYNGHAGGMEVQIVLAGNAFTAGKILFAVIPPGFPYENLSPAQLTMCPHVVVDVRQLEPILLPMPDIRNTFFHYNQSNGPKLRLVAMLYTPLRANNAGEDVFTVSCRVLTRPSPDFEFNFLVPPSVESKTKAFTLPILKISEMTNSRFPIPVDQMYTSRNENIVVQPQNGRVTLDGELQGTTTLQPVSICGFRGTLQTRLADQPNYTYQVHLENLDGSPVDPTDEVPAPLGTPDFQAQLFGVISQRSSDNATRAHEARVNTNDPTFAPQIAQVRFKSPSNDFFDNEPIKFTPVGISVDSQNSYNQWLLPRYGGHLTNNTHLAPSVSPMFPGEQILFFRSFMPGASGHTDGAIDCLLPQEWVAHFYQEAATAQTDVALIRFVNPDTGRVLFEGKLHKQGFITISNSGDHPIVMPANGYFRFEAWVNQFYSLAPVGTGSGRRRIQ

SEQ ID NO: 3799 - protein, 537 aa, Artificial Sequence
  VP1__Norovirus_and/or_Norovirus-like__AY038599
MKMASNDAAPSSDGAAGVVPEINHEVMAIEPVAGASIAAPVVGQQNIIDPWIRNNFVQAPAGEFTVSPRNAPGEFLLDLELGPDLNPYLAHLARMYNGHAGGMEVQIVLAGNAFTAGKILFAVIPPGFPYENLCPAQLTMCPHVVVDVRQLEPVMLPMPDIRNTFFHYNQDGGPKLRLIAMLYTPLRANNSGDDVFTVSCRVLTRPAPDFEFTFLVPPSIESKTKAFTIPVLKISEMTNSRFPVPVDQMYTSRSEGIVVQPQNGRATIDGELLGTTLVSPVSVCNFKGNLQAEVPGQHQLYQLQLTNLDGSPIDPTDDTPGPLGCPDFTGLLYGVASQRGPGDATRAHEARIDTGSDTFAPKIGQVRFYSTSSDFETNQPTHFTPIGIYIEGNSSDFNQWQLPRYGGHLANNNHLAPAVSPLFPGEQILFFRSFIPGASGHTNGEMDCLLPQEFVQHFYQEAATARSEVALLRFVNPDTGRALFESKLHKQGFMTIASSGDHPIIMPTNGYFRFEAWVNQFYSLAPVGTGSGRRRIQ

SEQ ID NO: 3800 - protein, 537 aa, Artificial Sequence
  VP1__Norovirus_and/or_Norovirus-like__AY054299
MKMASNDAAPSSDGAAGLVPEINHEVMAIEPVAGASIAAPVVGQQNIIDPWIRNNFVQAPAGEFTVSPRNAPGEFLLDLELGPDLNPYLAHLARMYNGHAGGMEVQIVLAGNAFTAGKILFAVIPPGFPYENLSPAQLTMCPHVVVDVRQLEPVMLPMPDIRNTFFHYNQDGGPRLRLIAMLYTPLRANNSGDDVFTVSCRVLTRPAPDFEFTFLVPPSIESKTKAFTIPVLKISEMTNSRFPVPVDQMYTSRSEGIVVQPQNGRATIDGELLGTTLVSPVSVCNFKGNLQAEVPGEHQLYQLQLTNLDGSPIDPTDDTPGPLGCPDFTGLLYGVASQRGPGDATRAHEARIDTGSDTYAPKIGQVRFYSTSSNFERNQPTHFTPIGIYIEGNSSDFNQWQLPRYGGHLANNNHLAPAVSPLFPGEQILFFRSFIPGASGHTNGEMDCLLPQEFVQHFYQEAATAQSEVALLRFVNPDTGRVLFESKLHKQGFMTIASSGDHPIIMPTNGYFRFEAWVNQFYSLAPVGTGSGRRRIQ

SEQ ID NO: 3801 - protein, 537 aa, Artificial Sequence
  VP1__Norovirus_and/or_Norovirus-like__AF195848
MKMASNDAAPSNDGAAGLVPEINHEVMAIEPVAGASLAAPVVGQLNIIDPWIRNNFVQAPAGEFTVSPRNAPGEFLLDLELGPELNPYLAHLARMYNGHAGGMEVQIVLAGNAFTAGKILFAVIPPGFPYENLSPAQLTMCPHVVVDVRQLEPILLPMPDIRNTFFHYNQSNGPKRRLVAMLYTPLRANNAGDDVFTVSCRVLTRPSPDFEFNFLVPPSVESKTKAFTLPVLKISEMTNSRFPIPVDQMYTSRNENIVVQPQNGRVTLDGELQGTTTLQPVSICGFRGTLQTRLADQPNYTYQVHLENLDGSPVDPTDEVPAPLGTPDFQAQLFGVISQRSSDNATRAHEARVNTNDPTFAPQIAQVRFKSPSTDFSDNEPIKFTPVGISVDSQNSYNQWLLPRYGGHLTNNTHLAPSVSPMFPGEQILFFRSFMPGAGGFTDGAIDCLLPQEWVAHFYQEAATAQTDVALIRFVNPDTGRVLFEGKLHKQGFITISNSGDHPIVMPANGYFRFEAWVKQFYSLAPVGTGSGRRRVQ

SEQ ID NO: 3802 - protein, 537 aa, Artificial Sequence
  VP1__Norovirus_and/or_Norovirus-like__AB303927
MKMASNDANPSDGSTANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPVPLEKLYTGPSSAFVVQPQNGRCTTDGVLLGTTQLSAVNICTFRGDVTHIAGSHDYTMNLASQNWNNYDPTEEIPAPLGTPDFVGKIQGVLTQTTREDGSTRAHKATVSTGSVHFTPKLGSVQYTTDTNNDFQTGQNTKFTPVGVIQDGSNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3803 - protein, 537 aa, Artificial Sequence
  VP1__Norovirus_and/or_Norovirus-like__AY038600
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYIMNLASQNWNNYDPTEEIPAPLGTPDFVGKIQGMLTQTTREDGSTRAHKATVSTGSVHFTPKLGSVQYTTDTNNDLQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3804 - protein, 537 aa, Artificial Sequence
  VP1__Norovirus_and/or_Norovirus-like__AF080554
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGVLTQTTKEDGSTRAHKATVSTGSVHFTPKLGSVQYTTDTNNDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3805 - protein, 537 aa, Artificial Sequence
  VP1__Norovirus_and/or_Norovirus-like__AB294778
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPVPLEKLYTGPSSAFVVQPQNGRCTTDGVLLGTTQLSAVNICTFRGDVTHIAGSHDYTMNLASQNWNNYDPTEEIPAPLGTPDFVGKIQGVLTQTTREDGSTRAHKATVSTGSVHFTPKLGSVQYTTDTNNDFQTGQNTKFTPVGVIQDGSNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3806 - protein, 537 aa, Artificial Sequence
  VP1__Norovirus_and/or_Norovirus-like__AB303922
MKMASNDATPSDGSTANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGVLTQTTRGDGSTRAHKATVSTGSVHFTPKLGSVQYTTDTNNDFQTGQNTKFTPVGVIQDGDNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3807 - protein, 537 aa, Artificial Sequence
  VP1__Norovirus_and/or_Norovirus-like__AY532128
MKMASNDANPSDGSTANLVPEVNNEVMALEPVVGAAIAAPVAGQQNIIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGILTQTTREDGSTRAHKATVSTGSVHFTPKLGSVQYTTDTNNDFQTGQNTKFTPVGVIQDGNNHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3808 - protein, 537 aa, Artificial Sequence
  VP1__Norovirus_and/or_Norovirus-like__AY532113
MKMASNDANPSDGSTANLVPEVNNEVMALEPVVGAAIAAPVAGQQNIIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGMLTQTTREDGSTRAHKATVSTGSVHFTPKLGSVQYTTDTNNDFQTGQNTKFTPVGVIQDGNNHQNEPHQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3809 - protein, 537 aa, Artificial Sequence
  VP1__Norovirus_and/or_Norovirus-like__EU078406
MKMASSDANPSDGSAANLVPEVNNEVMALEPVVGAAIAAPVAGQQNIIDPWIRNNFVQAPGGEFTVSPRNAPGEILWSAPLGPDLNPYLSHLSRMYNGYAGGFEVQVILAGNAFTAGKIIFAAVPPNFPTEGLSPSQVTMFPHVIVDVRQLEPVLIPLPDVRNNFYHYNQAHDPTIKLIAMLYTPLRANNAGDDVFTVSCRVLTRPSPDFDFIFLVPPTVESRTKPFTVPILTVEEMSNSRFPIPLEKLYTGPSSDFVVQPQNGRCTTDGVLLGTTQLSAVNICNFKGDVTHIAGSRDYRMNLVSQNWNNYDPTEEIPAPLGTPDFQGKIQGLLTQTTGADGSTRAHKATVSTGAANFTPKLGSVQFTTDTDNDFQTGQNTKFTPVGVIQDGSHHQNEPQQWVLPNYSGRTVHNVHLAPAVAPTFPGEQLLFFRSTMPGCSGYPNMNLDCLLPQEWVMHFYQEAAPAQSDVALLRFVNPDTGRVLFECKLHKAGYITVAHTGQHDLVIPPNGYFRFDSWVNQFYTLAPMGNGAGRRR

SEQ ID NO: 3810 - protein, 537 aa, Artificial Sequence
  VP1__Norovirus_and/or_Norovirus-like__AF472623
MKMASNDANPSDGSTANLVPEVNNEVMALEPVVGAAIAAPVAGQQNIIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGMLTQTTREDGSTRAHKATVSTGSVHFTPKLGSVQYTTDTNNDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3811 - protein, 537 aa, Artificial Sequence
  VP1__Norovirus_and/or_Norovirus-like__AF427114
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTASCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGVLTQTTREDGSTRAHKATVSTGSVHFTPKLGSVQYTTDTNNDFQTGQNTKFTPVGVIQDGSNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3812 - protein, 537 aa, Artificial Sequence
  VP1__Norovirus_and/or_Norovirus-like__AY532114
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGMLTQTTREDGSTRAHKATVSTGSVHFTPKLGSVQYTTDTNNDFQTGQNTKFTPVGVIQDGNNHQNEPHQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3813 - protein, 537 aa, Artificial Sequence
  VP1__Norovirus_and/or_Norovirus-like__KF806505
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSKDPTIKLIAMLYTPLRANNAGEDVFTVSCRVLTRPSPDFDFIFLVPPTVESRSKPFTVPILTVEEMTNSRFPIPLEKLFTGPSGAFVVQPQNGRCTTDGVLLGTTQLSPVNICTFRGDLTHFTGTSEYAMNLASQNWNNYDPTEEIPAPLGAPDFVGKIRGMLTQTTRRDGSTRGHRATLSTGSAHFTPKLGSIRFSTDTNNDFEAGQNTKFTPVGVFQEGDNHQNEPQQWVLPNYSGATAHNVHLAPAVAPAFPGEQLLFFRSTMPGCGGYPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRRR

SEQ ID NO: 3814 - protein, 537 aa, Artificial Sequence
  VP1__Norovirus_and/or_Norovirus-like__JQ478407
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDITHIAGSHDYTMNLASQNWSNYDPTEEIPAPLGTPDFVGKIQGMLTQTTREDGSTRAHKATVSTGSVHFTPKLGSVQYTTDTNNDFQTGQNTKFTPVGVIQDGGNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3815 - protein, 537 aa, Artificial Sequence
  VP1__Norovirus_and/or_Norovirus-like__AB303923
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGMLTQTTREDGSTRAHKATVSTGSVHFTPKLGSVQYTTDTNNDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3816 - protein, 537 aa, Artificial Sequence
  VP1__Norovirus_and/or_Norovirus-like__AF427120
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFIVQPQNGRCTTDGVLLGTTQLSAVNICTFRGDVTHIAGSHDYTMNLASQNWNNYDPTEEIPAPLGTPDFVGKIQGMLTQTTREDGSTRAHKATVSTGSVHFTPKLGSVQYTTDTNNDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3817 - protein, 537 aa, Artificial Sequence
  VP1__Norovirus_and/or_Norovirus-like__AY532134
MKMASNDANPSDGSTANLVPEVNNEVMALEPVVGAAIAAPVAGQQNIIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRIKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGVLTQTTREDGSTRAHKATVSTGSVHFTPKLGSVQYTTDTNNDFQTGQNTKFTPVGVIQDGNNHQNEPQQWVLPNYSGRAGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYALAPMGNGAGRRR

SEQ ID NO: 3818 - protein, 537 aa, Artificial Sequence
  VP1__Norovirus_and/or_Norovirus-like__AY532116
MKMASNDANPSDGSTANLVPEVNNEVMALEPVVGAAIATPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGMLTQTTREDGSTRAHKATVSTGSVHFTPKLGSVQYTTDTNNDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3819 - protein, 537 aa, Artificial Sequence
  VP1__Norovirus_and/or_Norovirus-like__AY532112
MKMASNDANPSDGSTANLVPEVNNEVMALEPVVGAAIAAPVAGQQNIIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTAPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGMLTQTTREDGSTRAHKATVSTGSVHFTPKLGSVQYTTDTNNDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3820 - protein, 537 aa, Artificial Sequence
  VP1__Norovirus_and/or_Norovirus-like__KX514275
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVGEMTNSRFPINLERLFTGPSSANVVQPQNGRCTIDGELLGTTQLSSVNICTFRGDVTHIGSTHHWTMNLASPNWNNYDPTEETPAPLGTPDFVGKIHGMLTQTTQENGSTRAHRATVYVGSADFTPKLGKVQFETDTEDDLAIRQNTKFTPVGVIQSSDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3821 - protein, 537 aa, Artificial Sequence
  VP1__Norovirus_and/or_Norovirus-like__KF806510
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSKDPTIKLIAMLYTPLRANNAGEDVFTVSCRVLTRPSPDFDFIFLVPPTVESRSKPFTVPILTVEEMTNSRFPIPLEKLFTGPSGAFVVQPQNGRCTTDGVLLGTTQLSPVNICTFRGDLTHFTGTSEYAMNLASQNWNNYDPTEEIPAPLGAPDFVGKIRGMLTQTTRRDGSTRGHRATLSTGSAHFTPKLGNIRFSTDTNNDFEAGQNTKFTPVGVFQEGDNHQNEPQQWVLPNYSGATAHNVHLAPAVAPAFPGEQLLFFRSTMPGCGGYPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRRR

SEQ ID NO: 3822 - protein, 537 aa, Artificial Sequence
  VP1__Norovirus_and/or_Norovirus-like__EU078410
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQTILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGMLTQTTREDGSTRAHKATVSTGSVHFTPKLGSVQYTTDTNNDFQAGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGTGRRR

SEQ ID NO: 3823 - protein, 537 aa, Artificial Sequence
  VP1__Norovirus_and/or_Norovirus-like__AF427123
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGVLTQTTREDGSTRAHKATVSTGSVHFTPKLGSVQYTTDTNNNFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3824 - protein, 537 aa, Artificial Sequence
  VP1__Norovirus_and/or_Norovirus-like__AY532135
MKMASNDANPPDGSTANLVPEVNNEVMALEPVVGAAIAAPVAGQQNIIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGVLTQTTREDGSTRAHKATVSTGSVHFTPKLGSVQYTTDTNNDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3825 - protein, 537 aa, Artificial Sequence
  VP1__Norovirus_and/or_Norovirus-like__AY532125
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGMLTQTTREDGSTRAHKATVSTGSVHFTPKLGSVQYTTDTNNDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3826 - protein, 537 aa, Artificial Sequence
  VP1__Norovirus_and/or_Norovirus-like__AJ277619
MKMASNDANPSDGSTANLVPEVNNEVMALEPVVGAAIAAPVAGQQNVIDPWIRSNFVQAPGGEFTVSPRNAPGEILWSAPLGPDLNPYLSHLARMYNGYAGGLEVQVVLAGNAFTAGKIIFAAVPPNFPTEGLSPSQVTMFPHIIVDVRQLEPVLIPLPDVRNNFYHYNQSNDSTIKLIAMLYTPLRANDAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGMLSQTTRGDDSTRAHKATVSTGSVHFTPKLGSVQYTTDTNNDFETGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQLYTLAPMGNGAGRRR

SEQ ID NO: 3827 - protein, 537 aa, Artificial Sequence
  VP1__Norovirus_and/or_Norovirus-like__AF080556
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGMLTQTTREDGSTRAHKATVSTGSVHFTPKLGSVQYTTDTNNDFQAGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3828 - protein, 537 aa, Artificial Sequence
  VP1__Norovirus_and/or_Norovirus-like__AF080550
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSSDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGMLTQTTREDGSTRAHKATVSTGSVHFTPKLGSVQYTTDTNNDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3829 - protein, 537 aa, Artificial Sequence
  VP1__Norovirus_and/or_Norovirus-like__EU078407
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGMLTQTTRGDGSTRAHKATVSTGSVHFTPKLGSVQFTTDTNNDFQTGQNTKFTPVGVIQDGDNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGTGRRR

SEQ ID NO: 3830 - protein, 537 aa, Artificial Sequence
  VP1__Norovirus_and/or_Norovirus-like__AB083781
MKMASNDANPSDGSTANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTLRGDVTHIAGSHDYTMNLASQNWNNYDPTEEIPAPLGTPDFVGKIQGMLSQTTRGDGSTRAHKATVSTGSVHFTPKLGSVQYTTDTNNDFETGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3831 - protein, 537 aa, Artificial Sequence
  VP1__Norovirus_and/or_Norovirus-like__AF427122
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTRLSAVNICTFRGDVTHIAGSRDYTMNLASQNWNNYDPTEEIPAPLGTPDFVGKIQGVLTQTTREDGSTRAHKATVSTGSVHFTPKLGSVQYTTDTNNDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGVGRRR

SEQ ID NO: 3832 - protein, 537 aa, Artificial Sequence
  VP1__Norovirus_and/or_Norovirus-like__AY532133
MKMASNDANPSDGSTANLVPEVNNEVMALEPVVGAAIAAPVAGQQNVIDPWIRNNFVQAPGGEFTVSPRNAPGEILWSAPLSPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRIKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGMLTQTTREDGSTRAHKATVSTGSVHFTPKLGSVQYTTDTNNDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3833 - protein, 537 aa, Artificial Sequence
  VP1__Norovirus_and/or_Norovirus-like__AY532131
MKMASNDANPSDGSTANLVPEVNNEVMALEPVVGAAIAAPVAGQQNIIDPWIRNNFVQAPGGEFTVSPRNAPGEILWSAPLGPDLNPYLSHLARVYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGMLTQTTREDGSTRAHKATVSTGSVHFTPKLGSVQYTTDTNNDFQTGQNTKFTPVGVIQDGNNHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3834 - protein, 537 aa, Artificial Sequence
  VP1__Norovirus_and/or_Norovirus-like__AY532121
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGTLTQTTREDGSTRAHKATVSTGSVHFTPKLGSVQYTTDTNNDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWINQFYTLAPMGNGAGRRR

SEQ ID NO: 3835 - protein, 537 aa, Artificial Sequence
  VP1__Norovirus_and/or_Norovirus-like__AY532115
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFDVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGMLTQTTREDGSTRAHKATVSTGSVHFTPKLGSVQYTTDTNNDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3836 - protein, 537 aa, Artificial Sequence
  VP1__Norovirus_and/or_Norovirus-like__KF806530
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSKDPTIKLIAMLYTPLRANNAGEDVFTVSCRVLTRPSPDFDFIFLVPPTVESRSKPFTVPILTVEEMTNSRFPIPLEKLFTGPSGAFVVQPQNGRCTTDGVLLGTTQLSPVNICTFRGDLTHFAGTHEYAMNLASQNWNNYDPTEEIPAPLGAPDFVGKIRGVLTQTTRRDGSTRGHRATLSTGSAHFTPKLGSIRFSTDTNNDFEAGQNTKFTPVGVFQDGDNHQNEPQQWVLPNYSGATAHNVHLAPAVAPAFPGEQLLFFRSTMPGCSGYPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRRR

SEQ ID NO: 3837 - protein, 537 aa, Artificial Sequence
  VP1__Norovirus_and/or_Norovirus-like__KF806513
MKMASNDASPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSKDPTIKLIAMLYTPLRANNAGEDVFTVSCRVLTRPSPDFDFIFLVPPTVESRSKPFTVPILTVEEMTNSRFPIPLEKLFTGPSGAFVVQPQNGRCTTDGVLLGTTQLSPVNICTFRGDLTHFTGTSEYAMNLASQNWNNYDPTEEIPAPLGAPDFVGKIRGMLTQTTRRDGSTRGHRATLSTGSAHFTPKLGSIRFSTDTNNDFEASQNTKFTPVGVFQEGDNHQNEPQQWVLPNYSGATAHNVHLAPAVAPAFPGEQLLFFRSTMPGCGGYPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRRR

SEQ ID NO: 3838 - protein, 537 aa, Artificial Sequence
  VP1__Norovirus_and/or_Norovirus-like__AY741811
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIIVDVRQLEPVLIPLPDVRNNFYHYNQSNDSTIKLIAMLYTPLKANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGMLTQTTREDGSTRAHKATVSTGSVHFTPKLGSVQYTTDTNNDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3839 - protein, 537 aa, Artificial Sequence
  VP1__Norovirus_and/or_Norovirus-like__AY532122
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFGGDVTHIAGSHDYTMNLASQNWNNYDPTEEIPAPLGTPDFVGKIQGMLTQTTREDGSTRAHKATVSTGSVHFTPKLGSVQYTTDTNNDFQTGQNTKFTPVGVIQDGDNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3840 - protein, 537 aa, Artificial Sequence
  VP1__Norovirus_and/or_Norovirus-like__AY532120
MKMASNDANPSDGSTANLVPEVNNEVMALEPVVGAAIAAPVAGQQNIIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNSFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGMLTQTTREDGSTRAHKATVSTGSVHFTPKLGSVQYTTDTNSDFQTGQNTKFTPVGVIQDGNNHQNEPQQWVLPNYSGGTGHNVHLAPAVAPTFPGEQLLFFRSTMPGCSGYPNMNLDCYSPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3841 - protein, 537 aa, Artificial Sequence
  VP1__Norovirus_and/or_Norovirus-like__AY532111
MKMASNDANPSDGSTANLVPEVNNEVMALEPVVGAAIAAPVAGQQNVIDPWIRNNFVQAPGGEFTVSPRNAPGEILWSAPLSPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGMLTQTTREDGSTRAHKATVSTGSVHFTPKLGSVQYTTDTNNDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQVYTLAPMGNGAGRRR

SEQ ID NO: 3842 - protein, 537 aa, Artificial Sequence
  VP1__Norovirus_and/or_Norovirus-like__AF080558
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGMLTQTTRGDGSTRAHKATVSTGSVHFTPKLGSVQFTTDTNNDFQTGQNTKFTPVGVTQDGDNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3843 - protein, 537 aa, Artificial Sequence
  VP1__Norovirus_and/or_Norovirus-like__KF806508
MKMASNDASPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSKDPTIKLIAMLYTPLRANNAGEDVFTVSCRVLTRPSPDFDFIFLVPPTVESRSKPFTVPILTVEEMTNSRFPIPLEKLFTGPSGAFVVQPQNGRCTTDGVLLGTTQLSPVNICTFRGDLTHFTGTSEYAMNLASQNWNNYDPTEEIPAPLGAPDFVGKIRGMLTQTTRRDGSTRGHRATLSTGSAHFTPKLGSIRFSTDTNNDFEAGQNTKFTPVGIFQEGDNHQNEPQQWVLPNYSGATAHNVHLAPAVAPAFPGEQLLFFRSTMPGCGGYPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRRR

SEQ ID NO: 3844 - protein, 537 aa, Artificial Sequence
  VP1__Norovirus_and/or_Norovirus-like__AF425766
MKMASNDANPSDGSTANLVPEVNNEVMALEPVVGAAIAAPVAGQQNVIDPWIRNNFIQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDLVGKIQGMLTQTTREDGSTRAHKATVSTGSVHFTPKLGSVQYTTDTSNDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3845 - protein, 537 aa, Artificial Sequence
  VP1__Norovirus_and/or_Norovirus-like__AJ583672
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKTIFAAVPPNFPTEGLSPSQVTMFPHIIVDVRQPEPVLIPLPDVRNNFYHYNQSNDPTIKLIAMLYTPLRANNAGDDVFTVSCRVLTRPSPDFDFIFLVPPTVESRTKPFTVPILTVEEMTNSRFPIPLEKLFTGPSNAFVVQPQNGRCTTDGVLLGTTQLSPVNICTFRGDVTHIAGTHDYTMNLASQNWNNYDPTEEIPAPLGTPDFVGKIQGVLSQTTRGDGSTRGHKATVSTGSVHFTPKLGSVQYTTDTNNDLEAGQSTKFTPVGVVQDGNNHQNEPQQWVLPNYSGRTGHNVHLVPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGTGRRR

SEQ ID NO: 3846 - protein, 537 aa, Artificial Sequence
  VP1__Norovirus_and/or_Norovirus-like__AY532119
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGMLTQTTREDGSTRAHKATVSTGSVHFTPKLGSVQYTTDTNSDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3847 - protein, 537 aa, Artificial Sequence
  VP1__Norovirus_and/or_Norovirus-like__AF080552
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGMLTQTTREDGSTRAHKATVSTGSVHFTPKLGSVQYTTDTNNDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPSGYFRFDSWVNQFYTLAPMGNGAGRRR

SEQ ID NO: 3848 - protein, 537 aa, Artificial Sequence
  VP1__Norovirus_and/or_Norovirus-like__KX514177
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPVNLERLFTGPSSANVVQPQNGRCTIDGELLGTTQLSSVNICTFRGDVTHIGTTQHWTMNLASPNWNNYDPTEETPAPLGTPDFVGKIHGMLTQTTQENGSTRAHRATVYVGSANFTPKLGKVQFETDTGDDLAIRQNTKFTPVGVIQSSDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3849 - protein, 537 aa, Artificial Sequence
  VP1__Norovirus_and/or_Norovirus-like__KF806514
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSKDPTIKLIAMLYTPLRANNAGEDVFTVSCRVLTRPSPDFDFIFLVPPTVESRSKPFTVPILTVEEMTNSRFPIPLEKLFTGPSGAFVVQPQNGRCTTDGVLLGTTQLSPVNICTFRGDLTHFTGTSEYAMNLASQNWDNYDPTEEIPAPLGAPDFVGKIRGMLTQTTRRDGSTRGHRATLSTGSAHFTPKLGNIRFSTDTNNDFEAGQNTKFTPVGVFQEGDNHQNEPQQWVLPNYSGATAHNVHLAPAVAPAFPGEQLLFFRSTMPGCGGYPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRRR

SEQ ID NO: 3850 - protein, 537 aa, Artificial Sequence
  VP1__Norovirus_and/or_Norovirus-like__AB303925
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLFTGPSSAFVVQPQNGRCTTDGVLLGTTQLSAVNICTFRGDVTHIAGSHDYTMNLASQNWNNYDPTEEIPAPLGTPDFVGKIQGMLTQTTREDGSTRAHKATVSTGSVHFTPKLGSVQYTTDTNNDFQTGQNTKFTPVGVIQDGNNHQNEPQQWVLPNYSGRTGHNVHLAPAVAPTFPGEQLLFFRSTMPGCSGYPNMDLDCLLPQEWVQHFYQEAAPAQSDVALLRFVNPDTGRVLFECKLHKSGYVTVAHTGPHDLVIPPNGYFRFDSWINQFYTLAPMGNGAGRRR

SEQ ID NO: 3851 - protein, 537 aa, Artificial Sequence
  VP1__Norovirus_and/or_Norovirus-like__KF806534
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSKDPTIKLIAMLYTPLRANNAGEDVFTVSCRVLTRPSPDFDFIFLVPPTVESRSKPFTVPILTVEEMTNSRFPIPLEKLFTGPSSAFVVQPQNGRCTTDGVLLGTTQLSPVNICTFRGDLTHFAGTSEYAMNLASQNWTNYDPTEEIPAPLGAPDFVGKIRGVLTQTTRRDGSTRGHRATLSTGSAHFTPKLGSIRFSTDTNNDFEAGQNTKFTPVGVFQDGDNHQNEPQQWVLPNYSGATAHNVHLAPAVAPAFPGEQLLFFRSTMPGCSGYPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRRR

SEQ ID NO: 3852 - protein, 537 aa, Artificial Sequence
  VP1__Norovirus_and/or_Norovirus-like__KF806519
MKMASNDASPSDGSAANLVPEVNNEVMALEPVVGATIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSKDPTIKLIAMLYTPLRANNAGEDVFTVSCRVLTRPSPDFDFIFLVSPTVESRSKPFTVPILTVEEMTNSRFPIPLEKLFTGPSGAFVVQPQNGRCTTDGVLLGTTQLSPVNICTFRGDLTHFTGTSEYAMNLASQNWNNYDPTEEIPAPLGAPDFVGKIRGMLTQTTRRDGSTRGHRATLSTGSAHFTPKLGNIRFSTDTNNDFEAGQNTKFTPVGVFQEGDNHQNEPQQWVLPNYSGATAHNVHLAPAVAPAFPGEQLLFFRSTMPGCGGYPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRRR

SEQ ID NO: 3853 - protein, 537 aa, Artificial Sequence
  VP1__Norovirus_and/or_Norovirus-like__AB303924
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVFCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGMLTQTTREDGSTRAHKATVSTGSVHFTPKLGSVQYTTDTNNDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3854 - protein, 537 aa, Artificial Sequence
  VP1__Norovirus_and/or_Norovirus-like__DQ975270
MKMASNDANPSDGSTANLVPEVNNEVMALEPVVGAAIAAPVAGQQNVIDPWIRNNFVQAPGGEFTVSPRNAPGEILWSAPLGPDLNPYLSHLARTYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGMLTQTTREDGSTRAHKATVSTGSVHFTPKLGSVQYTTDTNNDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3855 - protein, 537 aa, Artificial Sequence
  VP1__Norovirus_and/or_Norovirus-like__AF414424
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVGQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGVLTQTTREDGSTRAHKATVSTGSVHFTPKLGSVQYTTDTNNDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVTPPNGYFRFDSWVNQFYTLAPMGNGAGRRR

SEQ ID NO: 3856 - protein, 537 aa, Artificial Sequence
  VP1__Norovirus_and/or_Norovirus-like__LC048964
MKMASNDANPSDGSTANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKNQGLLSQTTRGDGSTRAHKATVSTGSVHFTPKLGSVQYTTDTNNDFETGQNTKFTPVGVIQDGNNHQNEPQQWALPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3857 - protein, 537 aa, Artificial Sequence
  VP1__Norovirus_and/or_Norovirus-like__AB684705
MKMASSDANPSDGSAANLVPEVNNEVMALEPVVGAAIAAPVAGQQNIIDPWIRNNFVQAPGGEFTVSPRNAPGEILWSAPLSPDLNPYLSHLSRMYNGYAGGFEVQVILAGNAFTAGKVIFAAVPPNFPTEGLSPSQVTMFPHIIVDVRQLEPVLIPLPDVRNNFYHYNQTHDSTLKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICNFRGDVTRVGISHDYTMNLVSQNWNNYDPTEEIPAPLGTPDFVGKIQGLLTQTTRADSSTRAHKATLSTGSVHFTPKLGSVQFTTDTNNDFQTGQNTKFTPVGVIQDSDHHQNEPQQWVLPNYSGSSGHNVHLAPAVAPTFPGEQLLFFRSTMPGCSGYPNMNLDCLLPQEWVLHFYQEAAPAQSDVALLRFVNPDTGRVLFECKLHKSGYITVAHTGPYDLVIPPNGYFRFDSWVNQFYTLAPMGNGTGRRR

SEQ ID NO: 3858 - protein, 537 aa, Artificial Sequence
  VP1__Norovirus_and/or_Norovirus-like__KF806523
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSKDPTIKLIAMLYTPLRANNAGEDVFTVSCRVLTRPSPDFDFIFLVSPTVESRSKPFTVPILTVEEMTNSRFPIPLEKLFTGPSGAFVVQPQNGRCTTDGVLLGTTQLSPVNICTFRGDLTHFTGTSEYAMNLASQNWNNYDPTEEIPAPLGAPDFVGKIRGMLTQTTRRDGSTRGHRATLSTGSAHFTPKLGNIRFSTDTNNDFEAGQNTKFTPVGVFQEGDNHQNEPQQWVLPNYSGATAHNVHLAPAVAPAFPGEQLLFFRSTMPGCGGYPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRRR

SEQ ID NO: 3859 - protein, 537 aa, Artificial Sequence
  VP1__Norovirus_and/or_Norovirus-like__AY532129
MKMASNDANPSDGSTANLVPEVNNEVMALEPVVGAAIAAPVAGQQNVIDPWIRNNFVQAHGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNSYDPTEEIPAPLGTPDFVGKIQGMLTQTTREDGSTRAHKATVSTGSVHFTPKLGSVQYTTDTNNDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3860 - protein, 537 aa, Artificial Sequence
  VP1__Norovirus_and/or_Norovirus-like__AY532124
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILARNAFTAGKVIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGMLTQTTREDGSTRAHKATVSTGSVHFTPKLGSVQYTTDTNNDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3861 - protein, 537 aa, Artificial Sequence
  VP1__Norovirus_and/or_Norovirus-like__KX514309
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLERLFTGPSSANVVQPQNGRCTIDGELLGTTQLSSVNICTFRGDVTHPGGSKIYTMNLASPNWNNYDPTEEIPAPLGTPDFVGKIHGMLTQTTKGEGSTRGHRATVYVGGANFTPKLGKVQFETDTGDDLAIRQNTKFTPVGVIQSSDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3862 - protein, 537 aa, Artificial Sequence
  VP1__Norovirus_and/or_Norovirus-like__KX514308
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLDKLFTGPSSANVVQPQNGRCTIDGELLGTTQLSSVNICTFRGDVTHIGSTRHWTMNLASPNWNNYDPTEETPAPLGTPDFVGKIHGMLTQTTQENGSTRAHRATVYVGSADFTPKLGKVQFETDTEDDLAIRQNTKFTPVGVIQSSDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3863 - protein, 537 aa, Artificial Sequence
  VP1__Norovirus_and/or_Norovirus-like__KX514283
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSKDSTIKLIAMLYTPLRANNAGDDVFTVSCRVLTRPSPDFDFIFLVPPTVESRSKPFSVPVLTVEEMTNSRFPVTLDKLFTGPSSTIVVQPQNGRCMIDGVLLGTTQLSPVNICTFRGDVTHPRDSTIYTMNLASPNWNNYDPTEEIPAPLGTPDFTGKIQGMLTQTTKGEGSTRGHRATVYVGSAEFTPKLGKVRFETDTEDDLVIRQNTKFTPVGVIQSSDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3864 - protein, 537 aa, Artificial Sequence
  VP1__Norovirus_and/or_Norovirus-like__KX514194
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLERLFTGPSSANVVQPQNGRCTIDGELLGTTQLSSVNICTFRGDVTHIGSTHHWTMNLASPNWNNYDPTEETPAPLGTPDFVGKIHGMLTQTTQGNGSTRGHRATVYVGSAEFTPKLGKVQFKTETDHDLAIRQNTKFTPVGVIQESDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3865 - protein, 537 aa, Artificial Sequence
  VP1__Norovirus_and/or_Norovirus-like__KY424340
MKMASSDANPSDGSAANLVPEVNNEVMALEPVVGAAIAAPVAGQQNIIDPWIRNNFVQAPGGEFTVSPRNAPGEILWSAPLGPDLNPYLSHLSRMYNGYAGGFEVQVILAGNAFTAGKVIFAAVPPNFPTEGLSPSQVTMFPHIIVDVRQLEPVLIPLPDVRNNFYHYNQSHDSTLKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICNFRGDVTHIVGSHDYTMNLASQNWSNYDPTEEIPAPLGTPDFVGKIQGLLTQTTRADGSTRAHKATVSTGSVHFTPKLGSVQFTTDTNNDFQTGQNTKFTPVGVIQDGDHHQNEPQQWVLPNYSGRTGHNVHLAPAVAPTFPGEQLLFFRSTMPGCSGYPNMNLDCLLPQEWVLHFYQEAAPAQSDVALLRFVNPDTGRVLFECKLHKSGYITVAHTGPYDLVIPPNGYFRFDSWVNQFYTLAPMGNGTGRRR

SEQ ID NO: 3866 - protein, 537 aa, Artificial Sequence
  VP1__Norovirus_and/or_Norovirus-like__LC016606
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHISGTHTYRMNLASQNWNNYDPTEEIPAPLGTPDFVGKIQGMLTQTTKGDGSTRGHKATVSTGSVDFTPKLGSVQFATDTNNDFETGQNTRFTPVGVIQDGSAHRNEPQQWVLPDYSGKTVHNVHLAPAVAPTFPGEQLLFFRSTMPGCSGYPNMDLDCLLPQEWVQHFYQEAAPAQSDVALLRFVNPDTGRVLFECKLHKTGYVTVAHTGQHDLVIPPNGYFRFDSWVNQFYTLAPMGNGAGRRR

SEQ ID NO: 3867 - protein, 537 aa, Artificial Sequence
  VP1__Norovirus_and/or_Norovirus-like__FJ537136
MKMASSDANPSDGSAANLVPEVNNEVMALEPVVGAAIAAPVAGQQNIIDPWIRNNFVQAPGGEFTVSPRNAPGEILWSAPLGPDLNPYLSHLSRMYNGYAGGFEVQVILAGNAFTAGKVIFAAVPPNFPTEGLSPSQVTMFPHIIVDVRQLEPVLIPLPDVRNNFYHYNQSHDSTLKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICNFRGDVTHIVGSHDYTMNLVSQNWSNYDPTEEIPAPLGTPDFVGKIQGLLTQTTRADGSTRAHKATVSTGSVHFTPKLGSVQFTTDTNNDFQTGQNTKFTPVGVIQDGDHHQNEPQQWVLPNYSGRTGHNVHLAPAVAPTFPGEQLLFFRSTMPGCSGYPNMNLDCLLPQEWVLHFYQEAAPAQSDVALLRFVNPDTGRVLFECKLHKSGYITVAHTGPYDLVIPPNGYFRFDSWVNQFYTLAPMGNGTGRRR

SEQ ID NO: 3868 - protein, 537 aa, Artificial Sequence
  VP1__Norovirus_and/or_Norovirus-like__AY532117
MKMASNDANPSDGSTANLVPEVNNEVMALEPVVGAAIAAPVAGQQNVIDPWIRNNFVLGPWGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGVLTQTTREDGSTRAHKATVSTGSVHFTPKLGSVQYTTDTSNDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPYDLVIPPNGYFRFDSWVNQFYTLAPMGNGAGRRR

SEQ ID NO: 3869 - protein, 537 aa, Artificial Sequence
  VP1__Norovirus_and/or_Norovirus-like__KX514279
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLERLFTGPSSANVVQPQNGRCTIDGELLGTTQLSSVNICTFRGDVTQIGSTHHWTMNLASPNWNNYDPTEETPAPLGTPDFVGKIHGMLTQTTQENGSTRAHRATVYVGSADFTPKLGKVQFETDTEDDLAIRQNTKFTPVGVIQSSDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3870 - protein, 537 aa, Artificial Sequence
  VP1__Norovirus_and/or_Norovirus-like__LC016602
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHISGTSTYRMNLASQNWNNYDPTEEIPAPLGTPDFVGKIQGMLTQTTKGDGSTRGHKATVSTGSVDFTPKLGSVQFDTDTNNDLETGQNTRFTPVGVIQDGSAHRNEPQQWVLPDYSGRTVHNVHLAPAVAPTFPGEQLLFFRSTMPGCSGYPNMDLDCLLPQEWVQHFYQEAAPAQSDVALLRFVNPDTGRVLFECKLHKTGYVTVAHTGQHDLVIPPNGYFRFDSWVNQFYTLAPMGNGAGRRR

SEQ ID NO: 3871 - protein, 537 aa, Artificial Sequence
  VP1__Norovirus_and/or_Norovirus-like__AF145896
MKMASSDANPSDGSAANLVPEVNNEVMALEPVVGAAIAAPVAGQQNIIDPWIRNNFVQAPGGEFTVSPRNAPGEILWSAPLGPDLNPYLSHLSRMYNGYAGGFEVQVILAGNAFTAGKVIFAAVPPNFPTEGLSPSQVTMFPHIIVDVRQLEPVLIPLPDVRNNFYHYNQSHDSTLKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICNFRGDVTHIVGSHDYTMNLASQNWSNYDPTEEIPAPLGTPDFVGKIQGLLTQTTRADGSTRAHKATVSTGSVHFTPKLGSVQFTTDTNNDFQTGQNTKFTPVGVIQDGDHHQNEPQQWVLPNYSGRTGHNVHLAPAVAPTFPGEQLLFFRSTMPGCSGYPNMNLDCLLPQEWVLHFYQEAAPAQSDVALLRFVNPDTGRVLFECKLHKSGYITVAHTGPFDLVIPPNGYFRFDSWVNQFYTLAPMGNGTGRRR

SEQ ID NO: 3872 - protein, 537 aa, Artificial Sequence
  VP1__Norovirus_and/or_Norovirus-like__AB684704
MKMASSDANPSDGSAANLVPEVNNEVMALEPVVGAAIAAPVAGQQNIIDPWIRNNFVQAPGGEFTVSPRNAPGEILWSAPLSPDLNPYLSHLSRMYNGYAGGFEVQVILAGNAFTAGKVIFAAVPPNFPTEGLSPSQVTMFPHIIVDVRQLEPVLIPLPDVRNNFYHYNQAHDSTLKLIAMLYTPLRANNAGDDVFTVSCRVLTRPSPDFDFIFLVPPTVESRTKPFTVPILTVEEMSNSKFPIPLEKLYTGPSSAFVVQPQNGRCTTDGVLLGTTQLSAVNICNFRGDVTRVGTSHDYTMNLVSQNWNNYDPTEEIPAPLGTPDFVGKIQGLLTQTTRADGSTRAHKATVSTGSVHFTPKLGSVQFTTDTNNDFETGQNTKFTPVGVIQDGDHHQNEPQQWVLPSYSGSSGHNVHLAPAVAPTFPGEQLLFFRSTMPGCSGYPNMNLDCLLPQEWVLHFYQEAAPAQSDVALLRFVNPDTGRVLFECKLHKSGYITVAHTGPYDLVIPPNGYFRFDSWVNQFYTLAPMGNGTGRRR

SEQ ID NO: 3873 - protein, 537 aa, Artificial Sequence
  VP1__Norovirus_and/or_Norovirus-like__JX401279
MKMASSDANPSDGSAANLVPEVNNEVMALEPVVGAAIAAPVAGQQNIIDPWIRNNFVQAPGGEFTVSPRNAPGEILWSAPLGPDLNPYLSHLSRMYNGYAGGFEVQVILAGNAFTAGKVIFAAVPPNFPTEGLSPSQVTMFPHIIVDVRQLEPVLIPLPDVRNNFYHYNQAHDSTLKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICNFRGDVTRVGTSHDYTMNLVSQNWNNYDPTEEIPAPLGTPDFVGKIQGLLTQTTRADGSTRAHKATVSTGSVHFTPKLGSVQFTTDTDNDFQTGQNTKFTPVGVIQDGDHHQNEPQQWVLPNYSGTSGHNVHLAPAVAPAFPGEQLLFFRSTMPGCSGYPNMNLDCLLPQEWVLHFYQEAAPAQSDVALLRFVNPDTGRVLFECKLHKSGYITVAHTGPYDLVIPPNGYFRFDSWVNQFYTLAPMGNGTGRRR

SEQ ID NO: 3874 - protein, 537 aa, Artificial Sequence
  VP1__Norovirus_and/or_Norovirus-like__GQ389627
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWSNYDPTEEIPAPLGTPDFVGKIQGMLTQTTREDGSTRAHKATVSTGSVHFTPKLGSVQYTTDTNNDFQTGQNTKFTPVGVIQDGNNHQNEPQQWVLPNYSGRTGHNVHLAPAVAPTFPGEQLLFFRSTMPGCSGYPNMNLDCLLPQEWVQHFCQEAAPAQSDVALLRFVNPDTGRVLFECKLHKSGYVTVAHTGPHDLVIPPNGYFRFDSWVNQFYTLAPMGNGAGRRR

SEQ ID NO: 3875 - protein, 537 aa, Artificial Sequence
  VP1__Norovirus_and/or_Norovirus-like__AF425763
MKMASNDANPSDGSTANLVPEVNNEVMALEPVVGAAIAAPVAGQQNVIDPWIRNNFVQAPRGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMPYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGMLTQTTREDGSTRAHKATVSTGSVHFTPRLGSVQYTTDTNNDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3876 - protein, 537 aa, Artificial Sequence
  VP1__Norovirus_and/or_Norovirus-like__AY532127
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDGRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGTLTQTTREDGSTRAHKATVSTGSVHFTPKLGSAQYTTDTNNDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3877 - protein, 537 aa, Artificial Sequence
  VP1__Norovirus_and/or_Norovirus-like__AY532118
MKMASNDANPSDGSTANLVPEVNNEVMALEPVVGAAIAAPVAGQQNIIDPWIRNNFVQAPGGEFTVSPRNAPGEILWSAPLGPDLNPYLSHLARMYNGYAGGFEVQVILAGNAFTAGKIIFAAVPPNFPTEGLGPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPVPLEKLYTGPSSAFVVQPQNGRCTTDGVLLGTTQLSAVNICTFRGDVTHIAGSRDYTMNLASQNWNNYDPTEEIPAPLGTPDFVGKIQGVLTQTTREDGSTRAHKATVSTGSVHFTPKLGSVQYTTDTDNDFQTGQNTKFTPVGVIQDGNNHQNEPQQWVLPNYSGRPGHNVHLAPAVAPTFLGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3878 - protein, 537 aa, Artificial Sequence
  VP1__Norovirus_and/or_Norovirus-like__KX514326
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLERLFTGPSSANVVQPQNGRCTIDGELLGTTQLSSVNICTFRGDVTQIGSTKHWTMNLASPNWNNYDPTEETPAPLGTPDFVGKIHGMLTQTTQENGSTRAHRATVYVGGANFTPKLGKVQFETDTVDDLEIRQNTKFTPVGVIQSSDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3879 - protein, 537 aa, Artificial Sequence
  VP1__Norovirus_and/or_Norovirus-like__KX514264
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPVNLERLFTGPSSANVVQPQNGRCTIDGELLGTTQLSSVNICTFRGDVTHIGSTHHWTMNLASPNWNNYDPTEETPAPLGTPDFVGKIHGMLTQTTQGSGSTRAHRATVYVGSAEFTPKLGKVQFQTETEDDLVIRQNTKFTPVGVIQESDHHRDEPQQWRLPNYSGANTFNVHLAPAVAPNFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3880 - protein, 537 aa, Artificial Sequence
  VP1__Norovirus_and/or_Norovirus-like__KX514171
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPVNLERLFTGPSSANVVQPQNGRCTIDGELLGTTQLSSVNICTFRGDVTHIGTTQHWTMNLASPNWNNYDPTEETPAPLGTPDFVGKIHGMLTQTTQGSGSTRAHRATVYVGSAEFTPKLGKVRFETDTEDDLVIRQNTKFTPVGVIQSSEHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3881 - protein, 537 aa, Artificial Sequence
  VP1__Norovirus_and/or_Norovirus-like__KX514170
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPVNLERLFTGPSSANVVQPQNGRCTIDGELLGTTQLSSVNICTFRGDVTHIGTTQHWIMNLASPNWNNYDPTEETPAPLGTPDFVGKIHGMLTQTTQGSGSTRAHRATVYVGSAEFTPKLGKVRFETDTEDDLVIRQNTKFTPVGVIQSSEHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3882 - protein, 537 aa, Artificial Sequence
  VP1__Norovirus_and/or_Norovirus-like__KF806533
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSKDPTIKLIAMLYTPLRANNAGEDVFTVSCRVLTRPSPDFDFIFLVPPTVESRSKPFTVPILTVEEMTNSRFPIPLEKLFTGPSSAFVVQPQNGRCTTDGVLLGTTQLSPVNICTFRGDLTHFAGTHEYAMNLASQNWTNYDPTEEIPAPLGAPDFVGKIRGVLTQTTRGDGSTRGHRATLSTGSAHFTPKLGSVRFSTDTNNDFEAGQNTKFTPVGVFQDGDNHQNEPQQWVLPNYSGATAHNVHLAPAVAPAFPGEQLLFFRSTMPGCSGYPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRRR

SEQ ID NO: 3883 - protein, 537 aa, Artificial Sequence
  VP1__Norovirus_and/or_Norovirus-like__KF806528
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSKDPTIKLIAMLYTPLRANNAWEDVFTVSCRVLTRPSPDFDFIFLVPPTVESRSKPFTVPILTVEEMTNSRFPIPLEKLFTGPSGAFVVQPQNGRCTTDGVLLGTTQLSPVNICTFRGDLTHFAGTHEYAMNLASQNWNNYDPTEEIPAPLGAPDFVGKIRGVLTQTTRRDGSTRGHRATLSTGSAHFTPKLGSIRFSTDTNNDFEAGQNTKFTPVGVFQDGDNHQNEPQQWVLPNYSGATAHNVHLAPAVAPAFPGEQLLFFRSTMPGCSGYPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRRR

SEQ ID NO: 3884 - protein, 537 aa, Artificial Sequence
  VP1__Norovirus_and/or_Norovirus-like__KF806527
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSKDPTIKLIAMLYTPLRANNAGEDVFTVSCRVLTRPSPDFDFIFLVPPTVESRSKPFTVPILTVEEMTNSRFPIPLEKLFTGPSSAFVVQPQNGRCTTDGVLLGTTQLSPVNICTFRGDLTHFAGTSEYAMNLASQNWTNYDPTEEIPAPLGAPDFVGKIRGVLTQTTRGDGSTRGHRATLSTGSAHFTPKLGSVRFSTDTNNDFEAGQNTKFTPVGVFQDGDNHQNEPQQWVLPNYSGATAHNVHLAPAVAPAFPGEQLLFFRSTMPGCSGYPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRRR

SEQ ID NO: 3885 - protein, 537 aa, Artificial Sequence
  VP1__Norovirus_and/or_Norovirus-like__KX514261
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPVNLERLFTGPSSANVVQPQNGRCTIDGELLGTTQLSSVNICTFRGDVTHIGSTHHWTMNLASPNWNNYDPTEETPAPLGTPDFVGKIHGMLTQTTQGSGSTRAHRATVYVGSAEFTPKLGKVQFQTETEDDLVIRQNTKFTPVGVIQESDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3886 - protein, 537 aa, Artificial Sequence
  VP1__Norovirus_and/or_Norovirus-like__AB684720
MKMASSDANPSDGSTANLVPEVNNEVMALEPVVGAAIAAPVAGQQNVIDPWIRNNFVQAPGGEFTVSPRNAPGEILWSAPLGPDLNPYLSHLSRMYNGYAGGFEVQVILAGNAFTAGKIIFAAVPPNFPTEGLSPSQVTMFPHIIVDVRQLEPVLIPLPDVRNNFYHYNQAHDSTLKLIAMLYTPLRANNAGDDVFTVSCRVLTRPSPDFDFIFLVPPTVESRTKPFSVPILTVEEMSNSRFPIPLEKLYTGPSSAFVVQPQNGRCTTDGVLLGTTQLSAVNICNFRGDVTHIRGSRDYTMNLVSQNWNNYDPTEEIPAPLGTPDFVGKIQGLLTQTTRADGSTRAHKATVSTGSVHFTPKLGSVQFTTDTDNDFQTGQNTKFTPVGVIQDSDHHQNEPQQWVLPNYSGASGHNVHLAPAVAPTFPGEQLLFFRSTMPGCSGYPNMNLDCLLPQEWVLHFYQEAAPAQSDVALLRFVNPDTGRVLFECKLHKSGYITVAHTGPYDLVIPPNGYFRFDSWVNQFYTLAPMGNGTGRRR

SEQ ID NO: 3887 - protein, 537 aa, Artificial Sequence
  VP1__Norovirus_and/or_Norovirus-like__LC016605
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQITMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPGTRTYRMNLASQNWNNYDPTEEIPAPLGTPDFVGKIQGMLTQTTKGDGSTRGHKATVSTGSVDFTPKLGSVQFDTDTNNDLETGQNTRFTPVGVIQDGSAHRNEPQQWVLPDYSGRTVHNVHLAPAVAPTFPGEQLLFFRSTMPGCSGYPNMDLDCLLPQEWVQHFYQEAAPAQSDVALLRFVNPDTGRVLFECKLHKTGYVTVAHTGQHDLVIPPNGYFRFDSWVNQFYTLAPMGNGAGRRR

SEQ ID NO: 3888 - protein, 537 aa, Artificial Sequence
  VP1__Norovirus_and/or_Norovirus-like__KF806529
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSKDPTIKLIAMLYTPLRANNAGEDVFTVSCRVLTRPSPDFDFIFLVPPTVESRSKPFTVPILTVEEMTNSRFPIPLEKLFTGPSGAFVVQPQNGRCTTDGVLLGTTQLSPVNICTFRGDLTHFAGTHEYAMNLASQNWSNYDPTEEIPAPLGAPDFVGKIRGVLTQTTRGDGSTRGHRATLSTGSAHFTPKLGSIRFSTDTNNDFEAGQNTKFTPVGVFQDGDNHQNEPQQWVLPNYSGATAHNVHLAPAVAPAFPGEQLLFFRSTMPGCSGYPDMNLDCLLPQEWVQHFYQEAAPAQSDVALLRFVNPDTSRVLFECKLHKSGYVTVAHTGQHDLVIPPNGYFRFDSWVNQFYTLAPMGNGTGRRR

SEQ ID NO: 3889 - protein, 537 aa, Artificial Sequence
  VP1__Norovirus_and/or_Norovirus-like__JX023286
MKMASSDANPSDGSAANLVPEVNNEVMALEPVVGAAIAAPVAGQQNIIDPWIRNNFVQAPGGEFTVSPRNAPGEILWSAPLGPDLNPYLSHLSRMYNGYAGGFEVQVILAGNAFTAGKVIFAAVPPNFPTEGLSPSQVTMFPHIIVDVRQLEPVLIPLPDVRNNFYHYNQAHDSTLKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICNFRGDVTRVGISHDYTMNLVSQNWNNYDPTEEIPAPLGTPDFVGKIQGLLTQTTRADGSTRAHKATVSTGSVHFTPKLGSVQFTTDTNNDFQTGQNTKFTPVGVIQDGDHHQNEPQQWVLPNYSGTSGHNVHLAPAVAPTFPGEQLLFFRSTMPGCSGYPNMNLDCLLPQEWVLHFYQEAAPAQSDVALLRFVNPDTGRVLFECKLHKSGYITVAHTGPYDLVIPPNGYFRFDSWVNQFYTLAPMGNGTGRRR

SEQ ID NO: 3890 - protein, 537 aa, Artificial Sequence
  VP1__Norovirus_and/or_Norovirus-like__FJ537137
MKMASNDANPSDGSAANLVPEVNNEVMALEPVVGAAIAAPVAGQQNVIDPWIRNNFVQAPGGEFTVSPRNAPGEILWSAPLGPDLNPYLSHLSRMYNGYAGGFEVQVILAGNAFTAGKVIFAAVPPNFPTEGLSPSQVTMFPHIIVDVRQLEPVLIPLPDVRNNFYHYNQAHDSTLKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICNFRGDVTHIVGSHDYTMNLVSQNWSNYDPTEEIPAPLGTPDFVGKIQGLLTQTTRADGSTRAHKATVSTGSVHFIPKLGSVQFTTDTNNDFQTGQNTKFTPVGVIQDGDHHQNEPQQWVLPNYSGRTGHNVHLAPAVAPTFPGEQLLFFRSTVPGCSGYPNMNLDCLLPQEWVSHFYQEAAPAQSDVALLRFVNPDTGRVLFECKLHKSGYITVAHTGPYDLVLPPNGYFRFDSWVNQFYTLAPMGNGTGRRR

SEQ ID NO: 3891 - protein, 537 aa, Artificial Sequence
  VP1__Norovirus_and/or_Norovirus-like__X76716
MKMASNDANPSDGSAANLVPEVNNEVMALEPVVGAAIAAPVAGQQNVIDPWIRNNFVQAPGGEFTVSPRNAPGEILWSAPLGPDLNPYLSHLSRMYNGYAGGFEVQVILAGNAFTAGKVIFAAVPPNFPTEGLSPSQVTMFPHIIVDVRQLEPVLIPLPDVRNNFYHYNQANDSTLKLIAMLYTPLRANNAGDDVFTVSCRVLTRPSPDFDFIFLVPPTVESRTKPFTVPVLTVEEMSNSRFPIPLEKLYTGPSSAFVVQPQNGRCTTDGVLLGTTQLSAVNICNFRGDVTHIAGSHDYTMNLASQNWSNYDPTEEIPAPLGTPDFVGKIQGLLTQTTRADGSTRAHKATVSTGSVHFTPKLGSVQFTTDTNNDFQAGQNTKFTPVGVIQDGDHHQNEPQQWLLPNYSGRTGHNVHLAPAVAPTFPGEQLLFFRSTMPGCSGYPNMNLDCLLPQEWVLHFYQEAAPAQSDVALLRFVNPDTGRVLFECKLHKSGYITVAHTGPYDLVLPPNGYFRFDSWVNQFYTLAPMGNGTGRRR

SEQ ID NO: 3892 - protein, 537 aa, Artificial Sequence
  VP1__Norovirus_and/or_Norovirus-like__KX514328
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLERLFTGPSSANVVQPQNGRCTIDGELLGTTQLSSVNICTFRGDVTQIGSTKHWTMNLASPNWNNYDPTEETPAPLGTPDFVGKIHGMLTQTTQENGSTRAHRATVYVGGANFTPKLGKVQFETDTVDDLEIRQNTKFTPVGVIQSSDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3893 - protein, 537 aa, Artificial Sequence
  VP1__Norovirus_and/or_Norovirus-like__KX514201
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHVIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLERLFTGPSSANVVQPQNGRCTIDGELLGTTQLSSVNICTFRGDVTHIGSTHHWTMNLASPNWNNYDPTEETPAPLGTPDFVGKIHGMLTQTTQGSGSTRAHRATVYVGSAEFTPKLGKVQFKTETDHDLTIRQNTKFTPVGVIQESDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3894 - protein, 537 aa, Artificial Sequence
  VP1__Norovirus_and/or_Norovirus-like__AB985442
MKMASSDANPSDGSAANLVPEVNNEVMALEPVVGAAIAAPVAGQQNIIDPWIRNNFVQAPGGEFTVSPRNAPGEILWSAPLGPDLNPYLSHLSRMYNGYAGGFEVQVILAGNAFTAGKVIFAAVPPNFPTEGLSPSQVTMFPHIIVDVRQLEPVLIPLPDVRNNFYHYNQSHDSTLKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICNFRGDVTHIVGSHDYTMNLASQNWSNYDPTEEIPAPLGTPDFVGKIQGLRTQTTRADGSTRAHKATVSTGSVHFTPKLGSVQFTTDTNNDFQTGQNTKFTPVGVIQDGDHHQNEPQQWVLPNYSGRTGHNVHLAPAVAPTFPGEQLLFFRSTMPGCSGYPNMNLDCLLPQEWVLHFYQEAAPAQSDVALLRFVNPDTGRVLFECKLHKSGYITVAHTGPYDLVIPPNGYFRFDSWVNQFYTLAPMGNGTGRRR

SEQ ID NO: 3895 - protein, 537 aa, Artificial Sequence
  VP1__Norovirus_and/or_Norovirus-like__LC016604
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPGTRTYRMNLASQNWNNYDPTEEIPAPLGTPDFVGKIQGMLTQTTKGDGSTRGHKATVSTGSVDFTPKLGSVQFDTDTNNDLETGQNTRFTPVGVIQDGSAHRNEPQQWVLPDYSGRTVHNVHLAPAVAPTFPGEQLLFFRSTMPGCSGYPNMDLDCLLPQEWVQHFYQEAAPAQSDVALLRFVNPDTGRVLFECKLHKTGYVTVAHTGQHDLVIPPNGYFRFDSWVNQFYTLAPMGNGAGRRR

SEQ ID NO: 3896 - protein, 537 aa, Artificial Sequence
  VP1__Norovirus_and/or_Norovirus-like__KF806532
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSKDPTIKLIAMLYTPLRANNAGEDVFTVSCRVLTRPSPDFDFIFLVPPTVESRSKPFTVPILTVEEMTNSRFPIPLEKLFTGPSSAFVVQPQNGRCTTDGVLLGTTQLSPVNICTFRGDLTHFAGTSEYAMNLASQNWTNYDPTEEIPAPLGAPDFVGKIRGVLTQTTRRDGSTRGHRATLSTGSAHFTPKLGSIRFSTDTNNDFEAGQNTKFTPVGVFQDGDNHQNEPQQWVLPNYSGATAHNVHLAPAVAPAFPGEQLLFFRSTMPGCSGYPNMNLDCLLTQEWVQHFYQEAAPAQSDVALLRFVNPDTSRVLFECKLHKSGYVTVAHTGQHDLVIPPNGYFRFDSWVNQFYTLAPMGNGTGRRR

SEQ ID NO: 3897 - protein, 537 aa, Artificial Sequence
  VP1__Norovirus_and/or_Norovirus-like__FJ537138
MKMASSDANPSDGSAANLVPEVNNEVMALEPVVGAAIAAPVAGQQNVIDPWIRNNFVQAPGGEFTVSPRNAPGEILWSAPLGPDLNPYLSHLSRMYNGYAGGFEVQVILAGNAFTAGKVIFAAVPPNFPTEGLSPSQVTMFPHIIVDVRQLEPVLIPLPDVRNNFYHYNQAHDSTLKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICNFRGDVTRVGISHDYTMNLVSQNWNNYDPTEEIPAPLGTPDFVGKIQGLLTQTTRADGSTRAHKATVSTGSVHFTPKLGSVQFTTDTNNDFQTGQNTKFTPVGVIQDGDHHQNEPQQWVLPNYSGTSGHNVHLAPAVAPTFPGEQLLFFRSTMPGCSGYPNMNLDCLLPQEWVLHFYQEAAPAQSDVALLRFVNPDTGRVLFECKLHKSGYITVAHTGPYDLVIPPNGYFRFDSWVNQFYTLAPMGNGTGRRR

SEQ ID NO: 3898 - protein, 537 aa, Artificial Sequence
  VP1__Norovirus_and/or_Norovirus-like__AY030098
MKMASSDANPSDGSTANLVPEVNNEVMALEPVVGAAIAAPVAGQQNIIDPWIRNNFVQAPGGEFTVSPRNAPGEILWSAPLGPDLNPYLSHLSRMYNGYAGGFEVQVILAGNAFTAGKVIFAAVPPNFPTEGLSPSQVTMFPHIIVDVRQLEPVLIPLPDVRNNFYHYNQSHDSTLKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICNFRGDVTHIVGSHDYTMNLVSQNWSNYDPTEEIPAPLGTPDFVGKIQGLLTQTTRADGSTRAHKATVSTGSVHFTPKLGSVQFTTDTNNDFQTGQNTKFTPVGVIQDGDHHQNEPQQWVLPDYSGRTGHNVHLAPAVAPTFPGEQLLFFRSTMPGCSGYPNMNLDCLLPQEWVLHFYQEAAPAQSDVALLRFVNPDTGRVLFECKLHKSGYITVAHTGPYDLVIPPNGYFRFDSWVNQFYTLAPMGNGTGRRR

SEQ ID NO: 3899 - protein, 537 aa, Artificial Sequence
  VP1__Norovirus_and/or_Norovirus-like__AY532130
MKMASNDANPSDGSTANLVPEVNNEVMALEPVVGAAIAAPVAGQQNIIDPWIRNNFVQAPGGEFTVSPRNAPGEILWSAPLGPDLNPYLSHLARMYNGYAGGFEVQVILAGNASTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRIKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGMLTQTTREDGSTRAHKATVSTGSAHFTPKLGSVQYTTDTNNDFQTGQNTKFTPVGVIQDGNNHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMRNGAGRRR

SEQ ID NO: 3900 - protein, 537 aa, Artificial Sequence
  VP1__Norovirus_and/or_Norovirus-like__KX514286
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLERLFTGPSSANVVQPQNGRCTIDGELLGTTQLSSVNICTFRGDVTHIGSTHHWTMNLASPNWNNYDPTEETPAPLGTPDFVGKIHGMLTQTTQENGSTRAHRATVYVGSADFTPKLGKVQFETDTEDDLAIRQNTKFTPVGVIQSSDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3901 - protein, 537 aa, Artificial Sequence
  VP1__Norovirus_and/or_Norovirus-like__KX514202
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLERLFTGPSSANVVQPQNGRCTIDGELLGTTQLSSVNICTFRGDVTHIGSTHHWTMNLASPNWNNYDPTEETPAPLGTPDFVGKIHGMLTQTTQGSGSTRAHRATVYVGSAEFTPKLGKVQFKTETDHDLTIRQNTKFTPVGVIQESDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3902 - protein, 537 aa, Artificial Sequence
  VP1__Norovirus_and/or_Norovirus-like__DQ358208
MKMASNDANPSDGSAANLVPEVNNEVMALEPVVGAAIAAPVAGQQNVIDPWIRNNFVQAPGGEFTVSPRNAPGEILWSAPLGPDLNPYLSHLSRMYNGYAGGFEVQVILAGNAFTAGKVIFAAVPPNFPTEGLSPSQVTMFPHIIVDVRQLEPVLIPLPDVRNNFYHYNQANDSTLKLIAMLYTPLRANNAGDDVFTVSCRVLTRPSPDFDFIFLVPPTVESRTKPFTVPVLTVEEMSNSRFPIPLEKLYTGPSSAFVVQPQNGRCTTDGVLLGTTQLSAVNICNFRGDVTHIAGSHDYTMNLASQNWSNYDPTEEIPAPLGTPDFVGKIQGLLTQTTRADGSTRAHKATVSTGSVHFTPKLGSVQFTTDTNNDFQAGQNTKFTPVGVIQDGDHHQNEPQQWSLPNYSGRTGHNVHLAPAVAPTFPGEQLLFFRSTMPGCSGYPNMNLDCLLPQEWVLHFYQEAAPAQSDVALLRFVNPDTGRVLFECKLHKSGYITVAHTGPYDLVLPPNGYFRFDSWVNQFYTLAPMGNGTGRRR

SEQ ID NO: 3903 - protein, 537 aa, Artificial Sequence
  VP1__Norovirus_and/or_Norovirus-like__AF414425
MKMASNDANPSDGSTANLVPEVNNEVMALEPVVGAAIAAPVAGQQNVIDPWIRNNFVQAPGGEFTASPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTASCRVLTRPSPDFDFIFLVPPTVESRTKPFTVPILTVEEMSNSRFPIPLEKLYTGPSSAFVVQPQSGRCTTDGVLLGTTQLSAVNICTFRGDVTHIAGSHDYTMNLASQNWNNYDPTEEIPAPLGTPDFVGKIQGMLTQTTREDGSTRAHKATVSTGSVHFTPKLGSVQYTTDTNNDFQTGQNTKFTPVGVIQDGNNHQNEPQQWVLPNYSGRTGHNVHLAPAVAPTFPGEQLLFFKSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3904 - protein, 537 aa, Artificial Sequence
  VP1__Norovirus_and/or_Norovirus-like__KX514348
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPVNLERLFTGPSSANVVQPQNGRCTIDGELLGTTQLSSVNICTFRGDVTQIGSTKHWTMNLASPNWNNYDPTEETPAPLGTPDFVGKIHGMLTQTTQENGSTRAHRATVYVGGANFTPKLGKVQFETDTVDDLEIRQNTKFTPVGVIQSSDHHRDEPQQWVLPSYSGRDTPNVHLAPAVAPNFPGEQLLFFRSTLPGCGGHHNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3905 - protein, 537 aa, Artificial Sequence
  VP1__Norovirus_and/or_Norovirus-like__KX514287
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLERLFTGPSSANVVQPQNGRCTIDGELLGTTQLSSVNICTFRGDVTQIGSTHHWTMNLASPNWNNYDPTEETPAPLGTPDFVGKIHGMLTQTTQENGSTRAHRATVYVGSADFTPKLGKVQFETDTGDDLAIRQNTKFTPVGVIQSSDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3906 - protein, 537 aa, Artificial Sequence
  VP1__Norovirus_and/or_Norovirus-like__KX514183
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPVNLERLFTGPSSANVVQPQNGRCTIDGELLGTTQLSSVNICTFRGDVTHIGTTQHWTMNLASPNWNNYDPTEETPAPLGTPDFVGKIHGMLTQTTQGSGSTRAHRATVYVGSAEFTPKLGKVRFETDTEDDLVIRQNTKFTPVGVIQSSEHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3907 - protein, 537 aa, Artificial Sequence
  VP1__Norovirus_and/or_Norovirus-like__KX514174
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPVNLERLFTGPSSANVVQPQNGRCTIDGELLGTTQLSSVNICTFRGDVTHIGTTQHWTMNLASPNWNNYDPTEETPAPLGTPDFVGKIHGMLTQTTQGSGSTRAHRATVYVGSAEFTPKLGKVRFETDTEDDLVIRQNTKFTPVGVIQSSEHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3908 - protein, 537 aa, Artificial Sequence
  VP1__Norovirus_and/or_Norovirus-like__KF429791
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPGQVTMFPHIIVDVRQLEPVLIPLPDVRNNFYHYNQSNDPTIKLVAMLYTPLRANNAGDDVFTVSCRVLTRPSPDFDFIFLVPPTIESKTKSFSVPILTIEEMTNSRFPIPLEKLFTGPSSTLVVQPQNGRCTTDGVLLGTTQLSPVNICTFRGDVTQITNTHSYEMNLAAQNWNSYDPTEEIPAPLGTPDFVGKIQGVLTQTTKENGSTRAHKATVYTGSTGFTPKLGRVQFVTDTDRDLETNQDTKFTPVGVIQDGDAHQNEPQQWVLPSYLGTNNHNVHLAPAVAPTFPGEQLLFFRSTMPGCSGYPNMNLDCLLPQEWVQYFYQEAAPAQSDVALLRFVNPDTGRVLFECKLHKSGYVTVAHTGRHDLVIPPNGYFRFDSWVSPFYTLAPMGNGTGRRR

SEQ ID NO: 3909 - protein, 537 aa, Artificial Sequence
  VP1__Norovirus_and/or_Norovirus-like__AF427115
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTIPILTGEEMSNSRFPIPLEKLYTGPSSAFVVQPQNGRCTTDGVLLGTTQLSAVNICTFKGNVIHIAGSHDYTMNLASQNWNNYDPTEETPAPLGTPDFVGKIQGLLTQTTREDGSTRAHKATVSAGSVHFTPKLGSVQYTTDTNNDFQTGQNTKFTPVGVIQDGNNHQNEPQQWVLPNYSGRAGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3910 - protein, 537 aa, Artificial Sequence
  VP1__Norovirus_and/or_Norovirus-like__KX514314
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLERLFTGPSSANVVQPQNGRCTIDGELLGTTQLSSVNICTFRGDVTQIGSTKHWTMNLASPNWNNYDPTEETPAPLGTPDFVGKIHGMLTQTTQENGSTRAHRATVYVGGANFTPKLGKVQFETDTGDDLAIRQNTKFTPVGVIQSSDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3911 - protein, 537 aa, Artificial Sequence
  VP1__Norovirus_and/or_Norovirus-like__KX514208
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLERLFTGPSSANVVQPQNGRCTIDGELLGTTQLSSVNICTFRGDVTHIGSTHHWTMNLASPNWNNYDPTEETPAPLGTPDFVGKIHGMLTQTTQGSGSTRAHRATVYVGSAEFTPKLGKVQFKTETDHDLSIRQNTKFTPVGVIQESDHHRDEPQQWRLPNYSGANTFNVHLAPAVAPNFPGEQLLFFRSTLPGCGGHPNMNLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3912 - protein, 537 aa, Artificial Sequence
  VP1__Norovirus_and/or_Norovirus-like__KX514206
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLERLFTGPSSANVVQPQNGRCTIDGELLGTTQLSSVNICTFRGDVTHIGSTHHWTMNLASPNWNNYDPTEETPAPLGTPDFVGKIHGMLTQTTQGSGSTRAHRATVYVGSAEFTPKLGKVQFKTETDHDLSIRQNTKFTPVGVIQESDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3913 - protein, 537 aa, Artificial Sequence
  VP1__Norovirus_and/or_Norovirus-like__KX514198
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLERLFTGPSSANVVQPQNGRCTIDGELLGTTQLSSVNICTFRGDVTHIGSTHHWTMNLASPNWNNYDPTEETPAPLGTPDFVGKIHGMLTQTTQGSGSTRAHRATVYVGSAEFTPKLGKVQFKTETDHDLTTRQNTKFTPVGVIQESDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3914 - protein, 537 aa, Artificial Sequence
  VP1__Norovirus_and/or_Norovirus-like__KX514191
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPVNLERLFTGPSSANVVQPQNGRCTIDGELLGTTQLSSVNICTFRGDVTHIGTTRHWTMNLASPNWNNYDPTEETPAPLGTPDFVGKIHGMLTQTTQGSGSTRAHRATVYVGSAEFTPKLGKVRFETDTEDDLVIRQNTKFTPVGVIQSSEHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3915 - protein, 537 aa, Artificial Sequence
  VP1__Norovirus_and/or_Norovirus-like__KX514187
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPVNLERLFTGPSSANVVQPQNGRCTIDGELLGTTQLSSVNICTFRGDVTHIGTTRHWTMNLVSPNWNNYDPTEETPAPLGTPDFVGKIHGMLTQTTQGSGSTRAHRATVYVGSAEFTPKLGKVRFETDTEDDLVIRQNTKFTPVGVIQSSEHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3916 - protein, 537 aa, Artificial Sequence
  VP1__Norovirus_and/or_Norovirus-like__KX514180
MKMASSDANPSDGSAANLVPEVNNEVMALEPVVGAAIAAPVAGQQNVIDPWIRNNFIQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLERLFTGPSSANVVQPQNGRCTIDGELLGTTQLSSVNICTFRGDVTQIGSTQHWTMNLASPNWNNYDPTEETPAPLGTPDFVGKIHGMLTQTTQENGSTRAHRATVYVGSANFTPKLGKVQFETDTGDDLAIRQNTKFTPVGVIQSSDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3917 - protein, 537 aa, Artificial Sequence
  VP1__Norovirus_and/or_Norovirus-like__GU598213
MKMASNDANPSDGSTANLVPEVNNEVMALEPVVGAAIAAPVAGQQNVIDSWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWSNYDPTEEIPAPLGTPDFVGKIQGMLTQTTREDGSTRAHKATVSTGSVHFTPKLGSVQYTTDTNNDFQTGQNTKFTPVGVIQDGNNHQNEPQQWVLPNYSGRTGHNVHLAPAVAPTFPGEQLLFFRSTMPGCSGYPNMNLDCLLPQEWVQHFCQEAAPAQSDVALLRFVNPDTGRVLFECKLHKSGYVTVAHTGPHDLVIPPNGYFRFDSWVNQFYTLAPMGNGAGRRR

SEQ ID NO: 3918 - protein, 537 aa, Artificial Sequence
  VP1__Norovirus_and/or_Norovirus-like__KX514365
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLERLFTGPSSANVVQPQNGRCTIDGELLGTTQLSSVNICTFRGDVTQIRSTQHWTMNLASPNWNNYDPTEETPAPLGTPDFVGKIHGMLTQTTQENGSTRAHRATVYVGSANFTPKLGKVQFETDTGDDLAIRQNTKFTPVGVIQSSDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3919 - protein, 537 aa, Artificial Sequence
  VP1__Norovirus_and/or_Norovirus-like__KX514304
MKMVSNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLERLFTGPSSANVVQPQNGRCTIDGELLGTTQLSSVNICTFRGDVTQIGSTKHWTMNLASPNWNNYDPTEETPAPLGTPDFVGKIHGMLTQTTQENGSTRAHRATVYVGGANFTPKLGKVQFETDTGDDLAIRQNTKFTPVGVIQSSDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3920 - protein, 537 aa, Artificial Sequence
  VP1__Norovirus_and/or_Norovirus-like__KX514302
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLERLFTGPSSANVVQPQNGRCTIDGELLGTTQLSSVNICTFRGDVTQIGSTQHWTMNLASPNWNNYDPTEETPAPLGTPDFVGKIHGMLTQTTQENGSTRAHRATVYVGGANFTPKLGRVQFETDTTDDLDAHQNTKFTPVGVIQSSDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3921 - protein, 537 aa, Artificial Sequence
  VP1__Norovirus_and/or_Norovirus-like__KX514207
MKMASSDANPSDGSAANLVPEVNNEVMALEPVVGAAITAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLERLFTGPSSANVVQPQNGRCTIDGELLGTTQLSSVNICTFRGDVTHIGSTHHWTMNLVSPNWNNYDPTEETPAPLGTPDFVGKIHGMLTQTTQGSGSTRAHRATVYVGSAEFTPKLGKVQFKTETDHDLSIRQNTKFTPVGVIQESDHHRDEPQQWRLPNYSGANAFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3922 - protein, 537 aa, Artificial Sequence
  VP1__Norovirus_and/or_Norovirus-like__KX514192
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPVNLERLFTGPSSANVVQPQNGRCTIDGELLGTTQLSSVNICTFRGDVTHIGATRHWTMNLASPNWNNYDPTEETPAPLGTPDFVGKIHGMLTQTTQGSGSTRAHRATVYVGSAEFTPKLGKVRFETDTEDDLVIRQNTKFTPVGVIQSSEHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3923 - protein, 537 aa, Artificial Sequence
  VP1__Norovirus_and/or_Norovirus-like__KF806525
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSKDPTIKLIAMLYTPLRANNAGEDVFTVSCRVLTRPSPDFDFIFLVPPTVESRSKPFTVPILTVEEMTYSRFPIPLEKLFTGPSSAFVVQPQNGRCTTDGVLLGTTQLSPVNICTFRGDLTHFAGTSEYAMNLASQNWTNYDPTEEIPAPLGAPDFVGKIRGVLTQTTRGDGSTRGHRATLSTGSAHFTPKLGSVRFSTDTNNDFEAGQNTKFTPVGVFQDGDNHQNEPQQWVLPNYSGATAHNVHLAPAVAPAFPGEQLLFFRSTMPGCSGYPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRRR

SEQ ID NO: 3924 - protein, 537 aa, Artificial Sequence
  VP1__Norovirus_and/or_Norovirus-like__KC462195
MKMASNDTIPSDGSTANLVPEVNNEVMALEPVVGAAIAAPVAGQQNVIDPWIRNNFVQAPGGEFTVSPRNAPGEILWSMPLSPDLNPYLSHLSRMYNGYAGGFEVQVILAGNAFTAGKIIFAAIPPNFPTDGLSPSQVTMFPHIIVDVRQLEPVLIPLPDVRNNFYHYNQVNDSTLKLIAMLYTPLRANNAGDDVFTVSCRVLTRPSPDFDFIFLVPPTVESRTKPFTVPILTVDEMTNSRFPTPLERLHTGPNNSLVVQPQNGRCTIDGVLLGTTQLSAVNICSFRGDSTTREGQSHAYTMNLASQNWTNYDPTEDIPAPLGTPDFVGKIVGMLSQTTRENSSTRAHKATVSTGDAHFMPKLGSVLFTTDTEDLQNGQNTRFTPVGVAQDGEPHQNEPQQWRLPNYSGTPGHNVHLAPPVAPTFPGEQLLFFRSTMPGCGGYPNMDLDCLLPQEWVRHFYQEAAPAQSDVALLRFVNPDTGRVLFECKLHKAGYITVSHTGPYDLVIPPNGYFRFDSWVNQFYALAPMGTGTGRRR

SEQ ID NO: 3925 - protein, 537 aa, Artificial Sequence
  VP1__Norovirus_and/or_Norovirus-like__AF427116
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTIPILTVEEMSNSRFPIPLEKLYTGPSSAFVVQPQNGRCTTDGVLLGTTQLSAVNICTFRGNVIHIAGSHDYTMNLASQNWNNYDPTEETPAPLGTSDFVGKIQGLLTQTTREDGSTRAHKATVSTGSVHFTPKLGSVQYTTDTNNDFQTGQNTKFTPVGVIQDGNNHQNEPQQWVLPNYSGRAGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3926 - protein, 537 aa, Artificial Sequence
  VP1__Norovirus_and/or_Norovirus-like__KX514337
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVGEMTNSRFPVNLERLFTGPSSANVVQPQNGRCTIDGELLGTTQLSSVNICTFRGDVTQIGATRHWTMNLASPNWNNYDPTEETPAPLGTPDFVGKVHGMLTQTTQGSGSTRAHRATVYVGGAEFTPKLGKVRFETDTEDDLVIRQNTKFTPVGVIQSSEHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3927 - protein, 537 aa, Artificial Sequence
  VP1__Norovirus_and/or_Norovirus-like__KX514255
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLERLFTGPSSANVVQPQNGRCTIDGELLGTTQLSSVNICTFRGDVTHIGSTHHWTMNLASPNWNNYDPTEETPAPLGTPDFVGKIHGMLTQTTQENGSTRAHRATVYVGSADFTPKLGKVQFETETDYDLAIRQNTKFTPVGVIQESDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3928 - protein, 537 aa, Artificial Sequence
  VP1__Norovirus_and/or_Norovirus-like__KX514210
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPVNLERLFTGPSSANVVQPQNGRCTIDGELLGTTQLSSVNICTFRGDVTHIGSTHHWTMNLASPNWNNYDPTEETPAPLGTPDFVGKIHGMLTQTTQGSGSTRAHRATVYVGSAEFTPKLGKVQFKTETDHDLSTRQNTKFTPVGVIQESDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3929 - protein, 537 aa, Artificial Sequence
  VP1__Norovirus_and/or_Norovirus-like__KX514182
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPVNLERLFTGPSSANVVQPQNGRCTIDGELLGTTQLSSVNICTFRGDVTHIGTTQHWTMNLASPNWNNYDPTEETPAPLGTPDFVGKIHGMLTQTTQGSGSTRAHRATVYVGSAEFTPKLGKVRFETDTEDDLVIRQNTKFTPVGVIQSSEHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRKR

SEQ ID NO: 3930 - protein, 537 aa, Artificial Sequence
  VP1__Norovirus_and/or_Norovirus-like__AF425764
MKMASNDANPSDGSTANLVPEVNNEVMALEPVVGAAIAAPVAGQQNVIDPWIRNNFVQAPGGGFTVSPRNAPGEILWSAPLGPDLNPYLSHLARMYNGYAGGFEVQVILAGSASTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGMLTQTTREDGSTRAHKATVSTGSVHFTPKLGSVQYTTDTNNDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3931 - protein, 537 aa, Artificial Sequence
  VP1__Norovirus_and/or_Norovirus-like__KX514355
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLERLFTGPSSANVVQPQNGRCTIDGELLGTTQLSSVNICTFRGDVTQIGSTQHWTMNLASPNWNNYDPTEETPAPLGTPDFVGKIHGMLTQTTQENGSTRAHRATVYVGGANFTPKLGKVQFETDTSDDLAIRQNTKFTPVGVIQSSDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3932 - protein, 537 aa, Artificial Sequence
  VP1__Norovirus_and/or_Norovirus-like__KX514345
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPVNLERLFTGPSSANVVQPQNGRCTIDGELLGTTQLSSVNICTFRGDVTQIGATRHWTMNLASLNWNNYDPTEETPAPLGTPDFVGKIHGMLTQTTQGSGSTRAHRATVYVGAAEFTPKLGKVRFETDTEDDLVIRQNTKFTPVGVIQSSEHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3933 - protein, 537 aa, Artificial Sequence
  VP1__Norovirus_and/or_Norovirus-like__KX514204
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLERLFTGPSSANVVQPQNGRCTIDGELLGTTQLSSVNICTFRGDVTHIGSTHHWTMNLASPNWNNYDPTEETPAPLGTPDFVGKIHGMLTQTTQGSGSTRAHRATVYVGGAEFTPKLGKVQFKTETDHDLSIRQNTKFTPVGVIQESDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3934 - protein, 537 aa, Artificial Sequence
  VP1__Norovirus_and/or_Norovirus-like__KF712492
MKMASSDANPSDGSTANLVPEANNEVMALEPVVGAAIAAPVAGQQNVIDPWIRNNFVQAPGGEFTVSPRNAPGEILWSAPLGPDLNPYLSHLSRMYNGYAGGFEVQVILAGNAFAAGKIIFAAVPPNFPTEGLSPSQVTMFPHLIVDVRQLEPVMIPLPDIRNNFYHYNQSNDPTIKLIAMLYTPLRANNVGDDVFTVSCRVLTRPSPDFDFIFLVPPTVESKTNPFSVPILTIEEMTNSRFPIPLEKLFTGPSSALVVQPQNGRCTTDGVLLGTTQLSPVNICTFRGDVTHTTKTHTYQMNLAAQNWNSYDPTEEIPAPLGTPDFVGKIQGVLTQTTKGNGSTRAHKATVYTGSAEFTPKLGRIQLFTDTDNDLEANQNTKFTPVGVIQDGDTHQNEPQQWVLPSYSGRNNHNVHLAPAVAPTFPGEQLLFFRSTMPGCSGYPNMNLDCLLPQEWVQYFYQEAAPAQSDVALLRFVNPDTGRVLFECKLHKSGYVTVAHTGHHDLFIPPNGYFRFDSWVSPFYTLAPMGNGTGRRR

SEQ ID NO: 3935 - protein, 537 aa, Artificial Sequence
  VP1__Norovirus_and/or_Norovirus-like__DQ078829
MKMASNDANPSDGSAANLVPEVNNEVMALEPVVGAAIAAPVAGQQNVIDPWIRNNFVQAPGGEFTVSPRNAPGEILWSAPLGPDLNPYPSHLARMYNGYAGGFEVQVILAGNAFTAGKIIFAAVPPNFPTEGLSPSQVTMFPHIIVDVRQLDPVLIPSPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWINYDPTEEIPAPLGTPDFVGKIQGMLTQTTREDGSTRAHKATVSTGSVHFTPKLGSVQYTTDTNNDFQTGQDTKFTPVGVIQDGNNHQNEPQQWVLPNYSGRTGHNVHLAPAVAPTFPGEQLLFFRSTMPGCSGYPNMNLDCLLPQEWVQHFYQEAAPAQPDVALLRFVNPDTGRVLFECKLHKSGYVTVAHTGPHDLVIPPNGYFRFDSWVNQFYTLAPMGNGAGRRR

SEQ ID NO: 3936 - protein, 537 aa, Artificial Sequence
  VP1__Norovirus_and/or_Norovirus-like__KX514370
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPVNLERLFTGPSSANVVQPQNGRCTIDGELLGTTQLSSVNICTFRGDVTQIGATRHWTMNLASPNWNNYDPTEETPAPLGTPDFVGKIHGMLTQTTQGSGSTRAHRATVYVGGAEFTPKLGKVRFETDTEDDLVIRQNTKFTPVGVIQSSEHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3937 - protein, 537 aa, Artificial Sequence
  VP1__Norovirus_and/or_Norovirus-like__KX514332
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLERLFTGPSSANVVQPQNGRCTIDGELLGTTQLSSVNICTFRGDVTQIGSTKHWTMNLASPNWNNYDPTEETPAPLGTPDFVGKIHGMLTQTTQENGSTRAHRATVYVGGANFTPKLGKVQFETDTVDDLEIRQNTKFTPVGVIQSSDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3938 - protein, 537 aa, Artificial Sequence
  VP1__Norovirus_and/or_Norovirus-like__KX514276
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPVNLERLFTGPSSANVVQPQNGRCTIDGELLGTTQLSSVNICTFRGDVTHIGTTHHWTMNLASPNWNNYDPTEETPAPLGTPDFVGKIHGMLTQTTQGSGSTRAHRATVYVGSAEFTPKLGKVRFETDTEDDLVIRQNTKFTPVGVIQSSDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3939 - protein, 537 aa, Artificial Sequence
  VP1__Norovirus_and/or_Norovirus-like__KX514256
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLEGLFTGPSSANVVQPQNGRCTIDGELLGTTQLSSVNICTFRGDVTHIGSTHHWTMNLASPNWNSYDPTEETPAPLGTPDFVGKIHGMLTQTTQGSGSTRAHRATVYVGSAEFTPKLGKVQFKTETNHDLSIRQNTKFTPVGVIQESDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPPNGYFRFDSWVNQFYTLAPMGNGTGRRR

SEQ ID NO: 3940 - protein, 537 aa, Artificial Sequence
  VP1__Norovirus_and/or_Norovirus-like__KX514209
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDLIFLVPPTVESRTKPFSVPILTVGEMTNSRFPVNLERLFTGPSSANVVQPQNGRCTIDGELLGTTQLSSVNICTFRGDVTHIGSTHHWTMNLASPNWNNYDPTEETPAPLGTPDFVGKIHGMLTQTTQGSGSTRAHRATVYVGSAEFTPKLGKVQFKTETDHDLSIRQNTKFTPVGVIQESDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3941 - protein, 537 aa, Artificial Sequence
  VP1__Norovirus_and/or_Norovirus-like__KX514205
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLERLFTGPSSANVVQPQNGRCTIDGELLGTTQLSSVNICTFRGDVTHIGSTHHWTMNLASPNWNNYDPTEETPAPLGTPDFVGKIHGMLTQTTQGSGSTRAHRATVYVGGAEFTPKLGKVQFKTETDHDLSIRQNTKFTPVGVIQESDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQHDLVIPPNGYFRFDSWVNQFYTLAPMGNGTGRRR

SEQ ID NO: 3942 - protein, 537 aa, Artificial Sequence
  VP1__Norovirus_and/or_Norovirus-like__KX514200
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLERLFTGPSSANVVQPQNGRCTIDGELLGTTQLSPVNICTFRGDVTHIGTTRHWTMNLASPNWNNYDPTEETPAPLGTPDFVGKIHGMLTQTTQGSGSTRAHRATVYVGSAEFTPKLGKVQFKTETDHDLSIRQNTKFTPVGVIQKSDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3943 - protein, 537 aa, Artificial Sequence
  VP1__Norovirus_and/or_Norovirus-like__KX514196
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNVFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLERLFTGPSSANVVQPQNGRCTIDGELLGTTQLSSVNICTFRGDVTHIGSTHHWTMNLASPNWNNYDPTEETPAPLGTPDFVGKIHGMLTQTTQGSGSTRAHRATVYVGGAEFTPKLGKVQFKTETDHDLTIRQNTKFTPVGVIQESDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3944 - protein, 537 aa, Artificial Sequence
  VP1__Norovirus_and/or_Norovirus-like__AB985437
MKMASNDANPSDGSAANLVPEVNNEVMALEPVVGAAIAAPVAGQQNVIDPWIRNNFVQAPGGEFTVSPRNAPGEILWSAPLGPDLNPYLSHLSRMYNGYAGGFEVQVILAGNAFTAGKVIFAAVPPNFPTEGLSPSQVTMFPHIIVDVRQLEPVLIPLPDVRNNFYHYNQAHDSTLKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICNFRGDVTHIVGSHDYTMNLVSQNWNNYDPTEEIPAPLGTPDFVGKIQGLLTQTTRADGSTRAHKATVSTGSVHFTPKLGSVQFTTDTNNDFQTGQNTKFTPVGVIQDGDHHQNEPQQWVLPNYSGTSGHNVHLAPAVAPTFPGEQLLFFRSTMPGCSGYPNMNLDCLLPQEWVLHFYQEAAPAQSDVALLRFVNPDTGRVLFECKLHKSSYITVAHTGPYDLVIPPNGYFRFDSWVNHFYTLAPMGNGTGGRR

SEQ ID NO: 3945 - protein, 537 aa, Artificial Sequence
  VP1__Norovirus_and/or_Norovirus-like__KF712494
MKMASSDANPSDGSTANLVPEANNEVMALEPVVGAAIAAPVAGQQNVIDPWIRNNFVQAPGGEFTVSPRNAPGEVLWSAPLGPDLNPYLSHLARMYNGYAGGFEVQVILAGNAFAAGKIIFAAVPPNFPTEGLSPSQVTMFPHLIIDVRQLEPVMIPLPDVRNNFYHYNQSNDPTIKLIAMLYTPLRANNVGDDVFTVSCRVLTRPSPDFDFIFLVPPTVESKTNPFSVPILTIEEMTNSRFPIPLEKLFTGPSSALVVQPQNGRCTTDGVLLGTTQLSPVNICTFRGDVTHITKTHSYQMNLAAQNWNSYDPTEEIPAPLGTPDFVGKIQGVLTQTTKGNGSTRAHKATVYTGSTEFTPKLGRIQLVTDTDNDLETNQNTKFTPVGVIQDGDTHQNEPQQWVLPSYLGRNNHNVHLAPAVAPTFPGEQLLFFRSTMPGCSGYPNMNLDCLLPQEWVQYFYQEAAPAQSDVALLRFVNPDTGRVLFECKLHKSGYVTVAHTGHHDLFIPPNGYFRFDSWVSPFYTLAPMGNGTGRRR

SEQ ID NO: 3946 - protein, 537 aa, Artificial Sequence
  VP1__Norovirus_and/or_Norovirus-like__KX514315
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLERLFTGPSSANVVQPQNGRCTIDGELLGTTQLSSVNICTFRGDVTQIGSTKHWTMNLASPNWNNYDPTEETPAPLGTPDFVGKIHGMLTQTTQENGSTRAHRATVYVGGANFTPKLGKVQFETDTGDDLAIRQNTKFTPVGVIQSSDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3947 - protein, 537 aa, Artificial Sequence
  VP1__Norovirus_and/or_Norovirus-like__KX514199
MKMASSDANPSDGSAANLVPEVNNEVMALEPVVGAAIVAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLERLFTGPSSANVVQPQNGRCTIDGELLGTTQLSSVNICTFRGDVTHIGSTHHWTMNLASPNWNNYDPTEETPAPLGTPDFVGKIHGMLTQTTQGSGSTRAHRATVYVGSAEFTPKLGKVQFKTETDHDLTIRQNTKFTPVGVIQESDHHRDEPQQWRLPNYSGANTFNVHLAPAVAPNFPGEQLLFFRSTLPGCGGHPNMDLDCLLPQEWVLHFYQEAAPAQSDVALLRFVNPDTSRVLFECKLHKSGYVTVAHTGQYDLVLPSNGYFRFDSWVNQFYTLAPMGNGTGRRR

SEQ ID NO: 3948 - protein, 537 aa, Artificial Sequence
  VP1__Norovirus_and/or_Norovirus-like__KX514176
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPVNLERLFTGPSSANVVQPQNGRCTIDGELLGTTQLSSVNICTFRGDVTRIGTTQHWTMNLASPNWNNYDPTEETPAPLGTPDFVGKIHGMLTQTTQGSGSTRAHRATVYVGSAEFTPKLGKVRFETDTEDDLVIRQNTKFTPVGVIQSSEHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3949 - protein, 537 aa, Artificial Sequence
  VP1__Norovirus_and/or_Norovirus-like__KX514360
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLERLFTGPSSANVVQPQNGRCTIDGELLGTTQLSSVNICTFRGDVTQIGSTKHWTMNLASPNWNNYDPTEETPAPLGTPDFVGKIHGMLTQTTQENGSTRAHRATVYVGGANFTPKLGKVQFETDTGDDLAIRQNTKFTPVGVIQSSDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3950 - protein, 537 aa, Artificial Sequence
  VP1__Norovirus_and/or_Norovirus-like__KX514347
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTQSGNTKIYTMNLASPNWNNYDPTEEIPAPLGTPDFVGKIHGMLTQTTQGSGSTRAHRATVYVGGAEFTPKLGKVRFETDTEDDLVIRQNTKFTPVGVIQSSEHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQHDLVLPSNGYFRFDSWVNQFYTLAPMGNGTGRRR

SEQ ID NO: 3951 - protein, 537 aa, Artificial Sequence
  VP1__Norovirus_and/or_Norovirus-like__AB684675
MKMASSDANPSDGSAANLVPEVNNEVMALEPVVGAAIAAPVAGQQNIIDPWIRNNFVQAPGGEFTVSPRNAPGEILWSAPLGPDLNPYLSHLSRMYNGYAGGFEVQVILAGNAFTAGKVIFAAVPPNFPTEGLSPSQVTMFPHIIVDVRQLEPVLIPLPDVRNNFYHYNQAHDSTLKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICNFLGDVTRVGTSHDYTMNLVSQNWDNYDPTEEIPAPLGTPDFVGKIQGLLTQTTRADRSTPAHKATVSTGSVHFTPKLGSVQFTTDTNNDFQTGQNTKFTPVGVIQDSDHHQNEPQQWVLPNYSGTTGHNVHLAPAVAPTFPGEQLLFFRVTMPGCSGYPNMNLDCLLPQEWVLHFYQEAAPAQSDVALLRFVNPDTGRVLFECKLHKSGYITVAHTGPYDLVIPPNGYFRFDSWVNQFYTLAPMGNGTGRRR

SEQ ID NO: 3952 - protein, 537 aa, Artificial Sequence
  VP1__Norovirus_and/or_Norovirus-like__KX514369
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPVNLERLFTGPSSANVVQPQNGRCTIDGELLGTTQLSSVNICTFRGDVTQIGATRHWTMNLASPNWNNYDPTEETPAPLGTPDFVGKIHGMLTQTTQGSGSTRAHRATVYVGGAEFTPKLGKVRFETDTEDDLVIRQNTKFTPVGVIQSSEHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3953 - protein, 537 aa, Artificial Sequence
  VP1__Norovirus_and/or_Norovirus-like__KX514310
MKMASNDTNPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHPRDSKIYTMNLASPNWNNYDPTEEIPAPLGTPDFVGKIHGMLTQTTQENGSTRAHRATVYVGGANFTPKLGKVQFETDTGDDLAIRQNTKFTPVGVIQSSDHHRDEPQQWRLPNYSGANTFNVHLAPAVAPTFPGEQLLFFRSTIPGCGGHPNMNLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3954 - protein, 537 aa, Artificial Sequence
  VP1__Norovirus_and/or_Norovirus-like__KX514185
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPVNLERLFTGPSSANVVQPQNGRCTIDGGLLGTTQLSSVNICTFRGDVTHIGTTRHWTMNLASPNWNNYDPTEETPAPLGTPDFVGKIHGMLTQTTQGSGSTRAHRATVYVGSAEFTPKLGKVRFETDTEDDLVIRQNTKFTPVGVIQSSEHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3955 - protein, 537 aa, Artificial Sequence
  VP1__Norovirus_and/or_Norovirus-like__KX514181
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKQFSVPILTVGEMTNSRFPVNLERLFTGPSSANVVQPQNGRCTIDGELLGTTQLSSVNICTFRGDVTHIGTTRHWTMNLASPNWNNYDPTEETPAPLGTPDFVGKIHGMLTQTTQGSGSTRAHRATVYVGSAEFTPKLGKVRFETDTEDDLVIRQNTKFTPVGVIQSSEHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3956 - protein, 537 aa, Artificial Sequence
  VP1__Norovirus_and/or_Norovirus-like__KF712493
MKMASSDANPSDGSTANLVPEANNEVMALEPVVGAAIAAPVAGQQNVIDPWIRNNFVQAPGGEFTVSPRNAPGEVLWSAPLGPDLNPYLSHLARMYNGYAGGFEVQVILAGNAFAAGKIIFAAVPPNFPTEGLSPSQVTMFPHLIVDVRQLEPVMIPLPDIRNNFYHYNQSNDPTIKLIAMLYTPLRANNVGDDVFTVSCRVLTRPSPDFDFIFLVPPTVESKTNPFSVPILTIEEMTNSRFPIPLEKLFTGPSSALVVQPQNGRCTTDGVLLGTTQLSPVNICTFRGDVTHTTKTHTYQMNLAAQNWNSYDPTEEIPAPLGTPDFVGKIQGVLTQTTKGNGSTRAHKATVYTGGVEFTPKLGRIQLFTDTDNDLEANQNTKFTPVGVIQDGDTHQNEPQQWVLPSYSGRNNHNVHLAPAVAPTFPGEQLLFFRSTMPGCSGYPNMNLDCLLPQEWVQYFYQEAAPAQSDVALLRFVNPDTGRVLFECKLHKSGYVTVAHTGHHDLFIPPNGYFRFDSWVSPFYTLAPMGNGTGRRR

SEQ ID NO: 3957 - protein, 537 aa, Artificial Sequence
  VP1__Norovirus_and/or_Norovirus-like__FJ411169
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGADVFTVSRRVLTRPSPDFDFIFSVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGMLTQTTREDGSTRAHKATVSTGSVHFTPKLGSVQYTTDTNNDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRR

SEQ ID NO: 3958 - protein, 537 aa, Artificial Sequence
  VP1__Norovirus_and/or_Norovirus-like__AF427121
MKMASNDANPSDGSTANLVPEVNNEVMTLEPVVGAAIAAPVAGQQNVIDPWIGNNIVQAPGGEFTVSPRNAPGEILWSAPLGPDLNPYLSHLARMYNGYAGGFEVQVILAGNAFTAGKIIFAAVPPNFPTEGLSPSQVTVFPHIIVDVRQLEPVLIPLPDVRNNFHHYNQSNDSTIKLIAMLYTPLRANNAGDDVFTVSCRVLTRPSPDFDFIFLVPPTIESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGVLTQTTREDGSTRAHKATVSTGSVHFTPKLGSVQYTTDTSNDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNSDTGRVLFECKLHKSGYVTVAHTGPHDLVIPPNGYFRFDSWVNQFYTLAPMGNGAGRRR

SEQ ID NO: 3959 - protein, 537 aa, Artificial Sequence
  VP1__Norovirus_and/or_Norovirus-like__KF429787
MKMASNDATPSDGSSANLVPEANNEVMALEPVAGAAIAAPVAGQQNVIDPWIRNNFVQAPGGEFTVSPRNAPGEILWSASLGPDLNPYLSHLSRMYNGYAGSFEVQVILAGNAFTAGKIIFAAVPPNFRTEGLSPSQITMFPHIITDVRQLEPVLIPLPDIRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTRIGNSREYRMNLASLNWNNYDPTEEIPAPLGTPDFAGKIQGVLTQTTRHDGSTRGHKATVYTGSAGFTPKLGSVQFSTDTDNDLEANQNTRFTPVGVIQDGNAHQGEPQQWVLPNYAGRDGHNVHLAPAVAPTFPGEQLLFFRSTMPGCSGYPNMNLDCLLPQEWVQHFYQESAPAQSDVALLRFVNPDTGRVLFECKLHKSGYVTVAHTGPHDLVIPPNGYFRFDSWVNQFYTLAPMGNGAGRRR

SEQ ID NO: 3960 - protein, 537 aa, Artificial Sequence
  VP1__Norovirus_and/or_Norovirus-like__AB933728
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAIPPNFPTEGLSPSQVTMFPHIVVDVRQLEPVLIPLPDVRNNFYHYNQTKESTIKLVAMLYTPLRANNAGDDVFTVSCRVLTRPSPDFDFIFLVPPSVESRTKPFTVPILTVEEMTNSRFPIPLERLFTGPSSAFVVQPQNGRCTTDGVLLGTTQLSPVNICTFRGDVTRVSTTHVYEMNLASQNWNNYDPTEEVPAPLGTPDFVGKIQGVLTQTTRTDGSTRAHKATVSTGAADFTPKLGSIRFETTTNRDLETHQNTKFTPVGVIQDGDNHQNEPQQWRLPGYAGRDAHNVHLAPAVAPTFPGEQLLFFRSTMPGCSGYPNMNLDCLLPQEWVQHFYQEAAPAQSDVALLRFVNPDTGRVLFECKLHKSGYLTVAHTGPYDLVIPPNGYFRFDSWVNQFYTLAPMGNGTGRRR

SEQ ID NO: 3961 - protein, 537 aa, Artificial Sequence
  VP1__Norovirus_and/or_Norovirus-like__KX514346
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPVNLERLFTGPSSANVVQPQNGRCTIDGELLGTTQLSSVNICTFRGDVTQIGSTKHWTMNLASPNWNNYDPTEETPAPLGTPDFVGKIHGMLTQTTQENGSTRAHRATVYVGGSNFTPKLGKVPFETDTGDDLAIRQNTKFTPVGVIQSSGHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3962 - protein, 537 aa, Artificial Sequence
  VP1__Norovirus_and/or_Norovirus-like__KX514249
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDLIFLVPPTVESRTKPFSVPILTVGEMTNSRFPINLEGLFTGPSSANVVQPQNGRCTIDGELLGTTQLSSVNICTFRGDVTHIGSTHHWTMNLASPNWNNYDPTEETPAPLGTPDFVGKIHGMLTQTTQGSGSTRAHRATVYVGGAEFTPKLGKVQFKTETNHDLSIRQNTKFTPVGVIQESDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3963 - protein, 537 aa, Artificial Sequence
  VP1__Norovirus_and/or_Norovirus-like__KF429760
MKMASNDATPSDGSSANLVPEVNNEVMALEPVAGAAIAAPVAGQQNVIDPWIRNNFVQAPGGEFTVSPRNAPGEILWSASLGPDLNPYLSHLSRMYNGYAGSFEVQVILAGNAFTAGKIIFAAVPPNFRTEGLSPSQITMFPHIITDVRQLEPVLIPLPDIRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTRIGNSREYRMNLASLNWNNYDPTEEIPAPLGTPDFAGKIQGVLTQTTRHDGSTRGHKATVYTGSAGFTPKLGSVQFSTDTDNDLEANQNTRFTPVGVIQDGNAHQGEPQQWVLPNYAGRDGHNVHLAPAVAPTFPGEQLLFFRSTMPGCSGYPNMNLDCLLPQEWVQHFYQESAPAQSDVALLRFVNPDTGRVLFECKLHKSGYVTVAHTGPHDLVIPPNGYFRFDSWVNQFYTLAPMGNGAGRRR

SEQ ID NO: 3964 - protein, 537 aa, Artificial Sequence
  VP1__Norovirus_and/or_Norovirus-like__AB303929
MKMASNDANPSDGSAANLVPEVNNEVMALEPVVGAAIAAPVAGQQNIIDPWIRNNFVQAPGGEFTVSPRNAPGEILWSAPLGPDLNPYLSHLSRMYNGYAGGFEVQVILAGNAFTAGKVIFAAVPPNFPTEGLSPSQVTMFPHIIVDVRQLEPVLIPLPDVRNNFYHYNQAHDSTLKLIAMLYTPLRANNAGDDVFTVSCRVLTRPSPDFDFIFLVPPTVESRTKPFTVPVLTVEEMTNSRFPIPLEKLYTGPSSAIVVQPQNGRCTTDGVLLGTTQLSAVNICTFRGDVTHIAGSRNYTMNLASQNWNNYDPTEEIPAPLGTPDFVGKIQGLLTQTTRADGSTRAHKATVSTGSVHFTPKLGSVQFSTDTDNDFQPGQNTKFTPVGVIQDGDRHQNEPQQWVLPDFSGRTGHNVHLAPAVAPTFPGEQLLFFRSTMPGRSGYPNMNLDCLLPQEWVLHFYQESAPAQSDVALLRFVNPDTNRVLFECKLHKSGYITVAHTGHHDLILPPNGYFRFDSWVNQFYTLAPMGNGAGRRR

SEQ ID NO: 3965 - protein, 537 aa, Artificial Sequence
  VP1__Norovirus_and/or_Norovirus-like__KX514363
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLERLFTGPSSANVVQPQNGRCTIDGELLGTTQLSSVNICTFRGDVTQIGSTQHWTMNLASPNWNNYDPTEETPAPLGTPDFVGKIHGMLTQTTQENGSTRAHRATVYVGGANFTPKLGKVRFETDTGDDLAIRQNTKFTPVGVIQSSDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3966 - protein, 537 aa, Artificial Sequence
  VP1__Norovirus_and/or_Norovirus-like__KX514357
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLERLFTGPSSANVVQPQNGRCTIDGELLGTTQLSSVNICTFRGDVTHIGSTHHWTMNLASPNWNNYDPTEETPAPLGTPDFVGKIHGMLTQTTQGSGSTRAHRATVYVGSADFTPKLGKVQFETETDHDLAIRQNTKFTPVGVIQESDNHRDEPQQWRLPNYSGANTFNVHLAPAVAPNFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3967 - protein, 537 aa, Artificial Sequence
  VP1__Norovirus_and/or_Norovirus-like__KX514240
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHPRDSPIYTMNLASPNWNNYDPTEEIPAPLGTPDFVGKIHGMLTQTTQGSGSTRAHRATVYVGSAEFTPKLGKVQFQTETEDDLVIRQNTKFTPVGVIQESDHHRDEPQQWVLPSYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3968 - protein, 537 aa, Artificial Sequence
  VP1__Norovirus_and/or_Norovirus-like__AF414417
MKMASNDANPSDGSAANLVPEVNNEVMALEPVVDAAIAAPVAGQQNVIDPWIRNNFVQAPGGEFTVSPRNAPGEILWSAPLGPDPNPYLSHLSRMYNGYAGGFEVQVILAGNAFTAGKVIFAAVPPNFPTEGLSPSQVTMFPHIIVDVRQLEPMLIPLPDVRNNFYHYNQANDSTLKLIATLYTPLRANNAGDDVFTVSCRVLTRPSPDFDFIFLVPPTVESRTKPFTVPVLTVEEMSNSRFPIPLEKLYTGPSSAFVVQPQNGRCTTDGVLLGTTQLSAVNICNFRGDVAHIAGSHDYTMNLASQNWSNYDPTEEIPAPLGTPDFVGKIQGLLTQTTRADGLTRAHKATVSTGSVHFTPKLGSVQFTTDTNNDFQAGQNTKFTPVGVIQDGDHHQNEPQQWLLPNYSGRTGHNVHLAPAVAPTFPGEQLLFFRSTMPGCSGYPNMNLDCLLPQEWVLHFYQEAAPAQSDVALLRFVNPDTGRVLFECKLHKSGYITVAHTGPYDLVLPPNGYFRFDSWVNQFYTLAPMGNGTGRRR

SEQ ID NO: 3969 - protein, 537 aa, Artificial Sequence
  VP1__Norovirus_and/or_Norovirus-like__KX514303
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPVNLERLFTGPSSANVVQPQNGRCTIDGELLGTTQLSSVNICTFRGDVTQIGSTRHWTMNLASPNWNNYDPTEETPAPLGTPDFVGKIHGMLTQTTQGSGSTRAHRATVYVGSAEFTPKLGKVRFETDTEDDLVIRQNTKFTPVGVIQSSDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3970 - protein, 537 aa, Artificial Sequence
  VP1__Norovirus_and/or_Norovirus-like__KX514273
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHPRDSPIYTMNLASPNWNNYDPTEEIPAPLGTPDFTGKIQGMLTQTTKGEGSTRGHRATVYVGSAEFTPKLGKVRFETDTEDDLVIRQNTKFTPVGVIQSSDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3971 - protein, 537 aa, Artificial Sequence
  VP1__Norovirus_and/or_Norovirus-like__KX514323
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHPGNSKIYTMNLASPNWNNYDPTEEIPAPLGTPDFVGKIHGMLTQTTQENGSTRAHRATVYVGGANFTPKLGKVQFETDTGDDLAIRQNTKFTPVGVIQSSDHHRDEPQQWRLPNYSGANTFNVHLAPAVAPNFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3972 - protein, 537 aa, Artificial Sequence
  VP1__Norovirus_and/or_Norovirus-like__KX514364
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLERLFTGPSSANVVQPQNGRCTIDGELLGTTQLSSVNICTFRGDVTQIGSTKHWTMNLASPNWNNYDPTEETPAPLGTPDFVGKIHGMLTQTTQENGSTRAHRATVYVGGANFTPKLGKVQFETDTGDDLAIRQNTKFTPVGVIQSSDHHRDEPQQWRLPNYSGANTFNVHLAPAVAPNFPGEQLLFFRSTLPGCGGHPNMDLDCLLPQEWVQHFYQEAAPAQSDVAPLRFVNPDTSRVLFECKLHKSGYVTVAHTGQYDLVLPSNGYFRFDSWVNQFYTLAPMGNGTGRRR

SEQ ID NO: 3973 - protein, 537 aa, Artificial Sequence
  VP1__Norovirus_and/or_Norovirus-like__KX514338
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSNFVVQPQNGRCMIDGVLLGTTQLSPVNICTFRGDVTQIGSTKHWTMNLASPNWNNYDPTEETPAPLGTPDFVGKIHGMLTQTTQENGSTRAHRATVYVGGANFTPKLGKVQFETDTVDDLEIRQNTKFTPVGVIQSSDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3974 - protein, 537 aa, Artificial Sequence
  VP1__Norovirus_and/or_Norovirus-like__KX514316
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHPRDSKIYTMNLASPNWNNYDPTEEIPAPLGTPDFVGKIQGMLTQTTKGEGSTRGHRATVYVGSANYAPKLGRVQFETDTTDDLDAHQNTKFTPVGVIQSSDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRKR

SEQ ID NO: 3975 - protein, 537 aa, Artificial Sequence
  VP1__Norovirus_and/or_Norovirus-like__KX514356
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNCYHYNQSNDSTIKLIAMLYTPLRANNPGDDVFTVSCRVLTRPSPDFDFIFLVPPTVESRTKPFSVPILTVGEMTNSRFPINLERLFTGPSSANVVQPQNGRCTIDGELLGTTQLSSVNICTFRGDVTHIGSTHHWIMNLASPNWNNYDPTEETPAPLGTPDFVGKIHGMLTQTTQGSGSTRAHRATVYVGSADFTPKLGKVQFETETDHDLAIRQNTKFTPVGVIQESDHHRDEPQQWRLPNYSGANTFNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3976 - protein, 537 aa, Artificial Sequence
  VP1__Norovirus_and/or_Norovirus-like__KX514349
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTQSGNTKIYTMNLASPNWNNYDPTEEIPAPLGTPDFVGKIQGMLTQTTKGEGSTRGHRATVYVGGAEFTPKLGKVRFETDTEDDLVIRQNTKFTPVGVIQTSENHRDEPQQWRLPNYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3977 - protein, 537 aa, Artificial Sequence
  VP1__Norovirus_and/or_Norovirus-like__KX514217
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHPRDSPIYTMNLASPNWNNYDPTEEIPAPLGTPDFVGKIQGMLTQTTQGSGSTRAHRATVYVGSAEFTPKLGKVQFQTETDHDLVIRQNTKFTPVGVIQESDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3978 - protein, 537 aa, Artificial Sequence
  VP1__Norovirus_and/or_Norovirus-like__KX514324
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHSGNSKIYTMNLASPNWNNYDPTEEIPAPLGTPDFVGKIQGMLTQTTKGEGSTRGHRATVYVGGANFTPKLGKVQFETDTVDDLEIRQNTKFTPVGVIQSSDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3979 - protein, 537 aa, Artificial Sequence
  VP1__Norovirus_and/or_Norovirus-like__KX514306
MKMASSDANPSDGSTANLVPEVNNEVMALEPVVGVAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFIVSCRVLTRPSPDFDFIFLVPPTVESRTKPFSVPILTVGEMTNSRFPINLERLFTGPSSANVVQPQNGRCTIDGELLGTTQLSSVNICTFRGDVTQIGSTQHWTMNLASPNWNNYDPTEETPAPLGTPDFVGKIQGMLTQTTQENGSTRAHRATVYVGGANYAPKLGKVQFETDTGDDLAIRQNTKFTPVGVIQSSDHHRDEPQQWRLPNYSGANTFNVHLAPAVAPNFPGEQLLFFRSTLPGCGGHPNMDLDCLLPQEWVQHFYQEAAPAQSDVTLLRFVNPDTSRVLFECKLHKSGYVTVAHTGQYDLVLPSNGYFRFDSWVNQFYTLAPMGNGTGRRR

SEQ ID NO: 3980 - protein, 537 aa, Artificial Sequence
  VP1__Norovirus_and/or_Norovirus-like__AB186063
MKMASNDVNPSDGSAANLVPEVNNEVMALEPVVGAAIAAPVAGQQNIIDPWIRNNFVQAPGGEFTVSPRNAPGEILWSAPLGPDLNPYLSHLSRMYNGYAGGFEVQVILAGNAFTAGKVIFAAVPPNFPTEGLSPSQVTMFPHIIVDVRQLEPVLIPLPDVRNNFYHYNQAHDSTLKLIAMLYTPLRANNAGDDVFTVSCRVLTRPSPDFDFIFLVPPTVESRTKPFTVPVLTVEEMTNSRFPIPLEKLYTGPSSAFVVQPQNGRCTTDGVLLGTTQLSAVNICTFRGDVTHIAGSRNYTMNLASQNWNNYDPTEEIPAPLGTPDFVGKIQGLLTQTTRADGSTRAHKATVSTGSVHFTPKLGSVQFSTDTDNDFQPGQNTKFTPVGVIQDGDRHQNEPQQWVLPDYSGRTGHNVHLAPAVAPTFPGEQLLFFRSTMPGCSGYPNMNLDCLLPQEWVLHFYQESAPAQSDVALLRFVNPDTNRVLFECKLHKSGYITVAHTGQHDLILPPNGYFRFDSWVNQFYTLAPMGNGAGRRR

SEQ ID NO: 3981 - protein, 537 aa, Artificial Sequence
  VP1__Norovirus_and/or_Norovirus-like__AF406793
MKMASSDANPSDGSTANLVPEVNNEVMALEPVVGAAIAGPVAGQQNVIDPWIRNNFVQAPGGEFTVSPTNAPGEILWSAPLGPDLNPYLSHLARMYNGYAGGFEVQVILAGNAFTAGKIIFAAVPPNFPTEGLSPSQVTMFPHIIVDVRQLEPVLIPLPDARNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSVFVVQPQNGRCTTDGVLLGTTQLSAVNICTFRGDVTHIAGSHDYTMNLASQNWNNYDPTEEIPAPLGTPDFVGKIQGMLTQTTREDGSTRATKATVSTGSVHFTPKLGSVQYTADTNNDFQTGQNTKFTPVGVIQDGSNHQNEPQQWVLTNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDPWVNQFYTLAPMGNGAGRRR

SEQ ID NO: 3982 - protein, 537 aa, Artificial Sequence
  VP1__Norovirus_and/or_Norovirus-like__KX514223
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLERLFTGPSSANVVQPQNGRCTIDGELLGTTQLSSVNICTFRGDVTHIGSTHHWTMNLASPNWNNYDPTEETPAPLGTPDFVGKIHGMLTQTTQGSGSTRAHRATVYVGSADFTPKLGKVQFETETDHDLAIRQNTKFTPVGVIQESDHHRDEPQQWRLPNYSGANTFNVHLAPAVAPNFPDEQLLFFRSTLPGCGGHPNMDLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3983 - protein, 537 aa, Artificial Sequence
  VP1__Norovirus_and/or_Norovirus-like__KX514318
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPVNLERLFTGPSSANVVQPQNGRCMIDGVLLGTTQLSPVNICTFRGDVTHPGGSKIYTMNLASPNWNNYDPTEEIPAPLGTPDFVGKIHGMLTQTTQENGSTRAHRATVYVGGANFTPKLGKVQFETDTEDDLAIRQNTKFTPVGVIQSSDHHRDEPQQWRLPNYSGRDTPNVHLAPTVAPNFPGEQLLFFRSTLPGCGGHPNMDLDCLLPQEWVQHFYQEAAPAQSDVTLLRFVNPDTSRVLFECKLHKSGYVTVAHTGQHDLVIPPNGYFRFDSWVNQFYTLAPMGNGTGRKR

SEQ ID NO: 3984 - protein, 537 aa, Artificial Sequence
  VP1__Norovirus_and/or_Norovirus-like__AB186065
MKMASNDVNPSDGSAANLVPEVNNEVMALEPVVGAAIAAPVAGQQNIIDPWIRNNFVQAPGGEFTVSPRNAPGEILWSAPLGPDLNPYLSHLSRMYNGYAGGFEVQVILAGNAFTAGKVIFAAVPPNFPTEGLSPSQVTMFPHIIVDVRQLEPVLIPLPDVRNNFYHYNQAHDSTLKLIAMLYTPLRANNAGDDVFTVSCRVLTRPSPDFDFIFLVPPTVESRTKSFTVPVLTVEEMTNSRFPIPLEKLYTGPSSAFVVQPQNGRCTTDGVLLGTTQLSAVNICTFRGDVTHIAGSRNYTMNLASQNWNNYDPTEEIPAPLGIPDFVGKIQGLLTQTTRADGSTRAHKATVSTGSVHFTPKLGSVQFSTDTDNDFQPGQNTKFTPVGVIQDGDRHQNEPQQWVLPDYSGRTGHNVHLAPAVAPTFPGEQLLFFRSTMPGCSGYPNMNLDCLLPQEWVLHFYQESAPAQSDVALLRFVNPDTNRVLFECKLHKSGYITVAHTGQHDLILPPNGYFRFDSWVNQFYTLAPMGNGAGRRR

SEQ ID NO: 3985 - protein, 537 aa, Artificial Sequence
  VP1__Norovirus_and/or_Norovirus-like__KX514307
MKMASSDANPSDGSTANLVPEVNNEVMALEPVVGAAIAAPVVGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLERLFTGPSSANVVQPQNGRCMIDGVLLGTTQLSPVNICTFRGDVTHPGGSKIYTMNLASPNWNNYDPTEETPAPLGTPDFVGKIHGMLTQTTQENGSTRAHRATVYVGGANFTPKLGKVRFETDTGDDLAIRQNTKFTPVGVIQSSDHHRDEPQQWRLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3986 - protein, 537 aa, Artificial Sequence
  VP1__Norovirus_and/or_Norovirus-like__LC048948
MKMASSDANPSDGSAANLVPEVNNEVMALEPVVGAAIAAPVAGQQNIIDPWIRNNFVQAPGGEFTVSPRNAPGEILWSAPLGPDLNPYLSHLSRMYNGYAGGFEVQVILAGNAFTAGKVIFAAVPPNFPTEGLSPSQVTMFPHIIVDVRQLEPVLIPLPDVRNNFYHYNQSHDSTLKLIAVLYTPLRTNNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICNFRGDVTHIVGSHETTMNLASQNWSNYDPTQKIPAPLGTPHFVGKIQGLLTQTTRAHGSTRAHKATVSTGSVHFTPKLGSVQFTTDTNNDFQTGQNTKFTPVGVIQDGDHHQNEPQQWVLPNYSGRTGHNVHLAPAVAPTFPGEQLLFFRSTMPGCSGYPNMNLDCLLPHEWVLHFYQEAAPAQSDVALLRFVNPDTGRVLFECKLHKSGYITVAHTGPFDLGIPPNGYFRFDSWVNQFYTLAPMGNGTGRRR

SEQ ID NO: 3987 - protein, 537 aa, Artificial Sequence
  VP1__Norovirus_and/or_Norovirus-like__LC048908
MKMASSDANPSDGSAANLVPEVNNEVMALEPVVGAAIAAPVAGQQNIIDPWIRNNFVQAPGGEFTVSPRNAPGEILWSAPLGPDLNPYLSHLSRMYNGYAGGFEVQVILAGNAFTAGKVIFAAVPPNFPTEGLSPSQVTMFPHIIVDVRQLEPVLIPLPDVRNNFYHYNQSHDSTLKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICNFRGDVTHIVGSHDYTMNLASQNWSNYDPTEEIPAPLGTPDFVGKIQGLLTQTTRAHGSTRAHKATVSTGSVHFTPKLGSVQFTTDTNNDFQTGQNTKFTPVGVIQDGDHHQNEPQQWVLPNYSGRTGHNVHLAPAVAPTFPGEQLLFFRSTMPGCSGYPNMNLDCLLPQEWVLHFYQETAPAQPDVALLRFVNPDTSRVLCECKLPKSGYITVAHTGPYDLVIPPNGYFRFDSWVNQFYTLAPMGNGTGRRR

SEQ ID NO: 3988 - protein, 537 aa, Artificial Sequence
  VP1__Norovirus_and/or_Norovirus-like__KX514312
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHPGGSKIYTMNLASPNWNNYDPTEEIPAPLGTPDFVGKIHGMLTQTTQENGSTRAHRATVYVGGANFTPKLGKVQFETDTGDDLAIRQNTKFTPVGVIQSSDHHRDEPQQWRLPNYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3989 - protein, 537 aa, Artificial Sequence
  VP1__Norovirus_and/or_Norovirus-like__KX514237
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILVGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHPRDSPIYTMNLASPNWNNYDPTEEIPAPLGTPDFVGKIQGMLTQTTQGSGSTRAHRATVYVGSADFTPKLGKVQFETETDHDLAIRQNTKFTPVGVIQESDHHRDEPQQWRLPNYSGANTFNVHLAPAVAPNFPGEQLLFFRSTLLGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3990 - protein, 537 aa, Artificial Sequence
  VP1__Norovirus_and/or_Norovirus-like__DQ419907
MKMASNDASPSDGSTANLVPEVNNEVMALEPVVGAAIAAPVAGQQNVIDPWIRNSSVQAPGGEFTVSPRDAPGEILWSAPLGPDLNPYLSHLARMYNGYAGGFEVQVILAGNAFTAGKIIFAAAPPNFPTEGLSPSQVTMFPHIIVGVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLENCSRVPAVPLSSNHKMQCTTDGVLLGTTQLSPVNICTFRGDVTHIPGTRTYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSSTHRNEPQQWVLPDYSGRTVHNVHLAPAVAPTFPGEQLLFFRSTMPGCSGYPNMDLDCLLPQEWVQHFYQEAAPSQSDVALLRFVNPDTGRVLFECKLHKAGYVTVAHTGQHDLVIPPNGYFRFDSWVNQFYTLAPMGNGAGRRR

SEQ ID NO: 3991 - protein, 537 aa, Artificial Sequence
  VP1__Norovirus_and/or_Norovirus-like__JN975543
MRMSDGAAPKANGSEASGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVLQPRLCTHARWPAPVYGLLVDPSLPSNPQWQNGRVHVDGTLLGTTPVSGSWVSCFAAEAAYEFQSGTGEVATFTLIEQDGTAYVPGDRAAPLGYPDFSGQLEIEVQTETTKAGDKLKVTTFEMILGPTTNVDQAPYQGRVYASITAMASLDLVDGRVRAVPRSIYSFQDVIPEYNDGLLVPLAPPIGPFLPGEVLLRFRTYMRQLDTADAAAEAIDCALPQEFISWFASNAFTVQSEALLLRYRNTLTGQLLFECKLYSEGYIALSYSGSGALTFPTDGFFEVVSWVPRLYQLASVGSLATGR

SEQ ID NO: 3992 - protein, 537 aa, Artificial Sequence
  VP1__Norovirus_and/or_Norovirus-like__JN975541
MRMSDGAAPKANGSEASGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVLQPRLCTHARWPAPVYGLLVDPSLPSNPQWQNGRVHVDGTLLGTTPVSGSWVSCFAAEAAYEFQSGTGEVATFTLIEQDGTAYVPGDRAAPLGYPDFSGQLEIEVQTETTKTGDKLKVTTFEMILGPTTNVDQAPYQGRVYASITAAASLDLVDGRVRAVPRSIYSFQDAIPEYNDGLLVPLAPPIGPFLPGEVLLRFRTYMRQLDTADAAAEAIDCALPQEFISWFASNAFTVQSEALLLRYRNTLTGQLLFECKLYSEGYIALSYSGSGALTFPTDGFFEVVSWVPRLYQLASVGSLATGR

SEQ ID NO: 3993 - protein, 537 aa, Artificial Sequence
  VP1__Norovirus_and/or_Norovirus-like__KF113526
MRMSDGAAPKANGSEASGQDLVPTAVEQAVPIQPVAGASLAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTAAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVLQPRLCTHARWPAPVYGLLVDPSLPSNPQWQNGRVHVDGTLLGTTPVSGSWVSCFAAEAAYEFQSGTGEVATFTLIEQDGSAYVPGDRAAPLGYPDFSGQLEIEVQTETTKAGDKLKVTTFEMILGPTTNVDQAPYQGRVYASLTAAASLDLVDGRVRAVPRSIYGFQDQIPEYNDGLLVPLAPPVGPFLPGELLLRFRTYMRQIDSADAAAEAIDCALPQEFISWFASNAFTVQSEALLLRYRNTLTGQLLFECKLYSEGYIALSYSGSGPLTFPTDGFFEVVSWVPRLYQLASVGSLATGR

SEQ ID NO: 3994 - protein, 537 aa, Artificial Sequence
  VP1__Norovirus_and/or_Norovirus-like__KF113527
MRMSDGAAPKANGSEASGQDLVPTAVEQAVPIQPVAGASLAAPAAGQINQIDPWIFQNFVQCPLGEFSISPRNAPGEILFDLALGPGLNPYLAHLSAMYTGWVGNMEVQLVLAGNAFTASKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVLQPRLCTHARWPAPVYGLLVDPSLPSNPQWQNGRVHVDGTLLGTTPVSGSWVSCFAAEAAYEFQSGTGEVATFTLIEQDGSAYVPGDRAAPLGYPDFSGQLEIEVQTETTKAGDKLKVTTFEMILGPTTNVDQAPYQGRVYASLTAAASLDLVDGRVRAVPRSIYGFQDQIPEYNDGLLVPLAPPVGPFLPGELLLRFRTYMRQIDSADAAAEAIDCALPQEFISWFASNAFTVQSEALLLRYRNTLTGQLLFECKLYSEGYIALSYSGSGPLTFPTDGFFEVVSWVPRLYQLASVGSLATGR

SEQ ID NO: 3995 - protein, 537 aa, Artificial Sequence
  VP1__Norovirus_and/or_Norovirus-like__KM458057
MRMSDGAAPKADGSEASGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVIQPRLCTHARWPAPVYGLLVDPSLPSNPQWQNGRVHVDGTLLGTTPVSGSWVSCFAAEAAYEFQSGTGQVATFTLIEQDGSAYVPGDRAAPLGYPDFSGQLEIEVQTETTKTGDKLKVTTFEMILGPTTNVDQAPYQGKVFASITAAASLDLVDGRVRAVPRSIYGFQDVIPEYNDGLLVPLAPPIGPFLPGEVLLRFRTYMRQLDTADAAAEAIDCALPQEFISWFASNVFTVQSEALLLRYRNTLTGQLLFECKLYSEGYIALSYSGSGPLTFPTDGFFEVVSWVPRLYQLASVGSLATGR

SEQ ID NO: 3996 - protein, 537 aa, Artificial Sequence
  VP1__Norovirus_and/or_Norovirus-like__AB662855
MKMASNDAAPSTDGAAGLVPESNNEVMALEPVAGAALAAPVTGQTNIIDPWIRANFVQAPNGEFTVSPRNAPGEVLLSLELGPELNPYLAHLARMYNGHAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDVPAPLGVPDFQGRVFGVISQRDKQNAAGHNEPANRGHDAVVPTYTAQYTPKLGQVQIGTWQTDDLQVNQPVKFTPVGLNDTEHFNQWVVPRYAGALNLNTNLAPSVAPVFPGERLLFFRSYIPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNG

SEQ ID NO: 3997 - protein, 537 aa, Artificial Sequence
  VP1__Norovirus_and/or_Norovirus-like__AB809997
MKMASNDAAPSNDGAASLVPEAINETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFIYLVPPSVESKTKPFTLPILTISELTNSRFPIPIEQLYTAPNENNVVQCQNGRCTLDGELQGTTQLLSSAVCSYRGRTVANSGDNWDQNLLQLTYPSGASYDPTDEVPAPLGTQDFSGILYGVLTQDNEREGTGEAKNAKGVYISTTSGKFTPKIGSIGLHSITENVHPNQQSRFTPVGVAQNENTPFQQWVLPHYAGALALNTNLAPAVAPTFPGEQLLFFRSRVPCVQGLRGQDAFIDCLLPQEWVNHFYQEAAPSQADVALIRYVNPDTGRTLFEAKLHRSGFITVSHTGAYPLVVPPNGHFRFDSWVNQFYSLAPMGTGNG

SEQ ID NO: 3998 - protein, 537 aa, Artificial Sequence
  VP1__Norovirus_and/or_Norovirus-like__AB810001
MKMASNDAAPSNDGAASLVPEAINETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFIYLVPPSVESKTKPFTLPILTISELTNSRFPIPIEQLYTAPNENNVVQCQNGRCTLDGELQGTTQLLSSAVCSYRGRTVANSGDNWDQNLLQLTYPSGASYDPTDEVPAPLGTQDFSGILYGVLTQDNVSEGTGEAKNAKGVYISTTSGKFTPKIGSIGLHSITENVHPNQQSRFTPVGVAQNENTPFQQWVLPHYAGALALNTNLAPAVAPTFPGEQLLFFRSRVPCVQGLRGQDAFIDCLLPQEWVNHFYQEAAPSQADVALIRYVNPDTGRTLFEAKLHRSGFITVSHTGAYPLVVPPNGHFRFDSWVNQFYSLAPMGTGNG

SEQ ID NO: 3999 - protein, 537 aa, Artificial Sequence
  VP1__Norovirus_and/or_Norovirus-like__AB809992
MKMASNDAAPSNDGAASLVPEAINETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFIYLVPPSVESKTKPFTLPILTISELTNSRFPIPIEQLYTAPNENNVVQCQNGRCTLDGELQGTTQLLSSAVCSYRGRTVANSGDNWDQNLLQLTYPSGASYDPTDEVPAPLGTQDFSGILYGVLTQDNVSEGTGEAKNAKGVYISTTSGKFTPKIGSIGLHSITENVHPNQQSRFTPVGVAQNENTPFQQWVLPHYAGALALNTNLAPAVAPTFPGEQLLFFRSRVPCVQGLRGQDAFIDCLLPQEWVDHFYQEAAPSQADVALIRYVNPDTGRTLFEAKLHRSGFITVSHTGAYPLVVPPNGHFRFDSWVNQFYSLAPMGTGNG

SEQ ID NO: 4000 - protein, 536 aa, Artificial Sequence
  VP1__Norovirus_and/or_Norovirus-like__AY130761
MKMASNDATPSDDGAAGLVPEINNEVMALEPVAGASIAAPVVGQQNIIDPWIRNNFVQAPAGEFTVSPRNSPGELLLDLELGPELNPYLAHLARMYNGHAGGMEVQIVLAGNAFTAGKILFAAIPPSFPYENLSPAQLTMCPHVIVDVRQLEPVLLPMPDIRNVFYHYNQNNSPKLRLVAMLYTPLRANNSGDDVFTVSCRVLTRPSPDFQFTFLVPPTVESKTKNFTLPVLRVSEMTNSRFPVVLDQMYTSRNENIIVQPQNGRCTTDGELLGTTTLQSVSICNFRGTMQAKLNEQPRYQLQLTNLDGSPIDPTDDMPAPLGTPDFQAMLYGVASQRSSRDNATRAHDAQIDTAGDTFAPKIGQVRFKSSSDDFDLHDPTKFTPIGVNVDDQHPFRQWSLPNYGGHLALNNHLAPAVTPLFPGEQILFFRSHIPSAGGHTDGAIDCLLPQEWIEHFYQEAAPSQSDIALVRFINPDTGRVLLEAKLHKQGFLTVAASGDHPIVMPTNGYFRFEAWVNPFYTLAPVGTGSGRRRIQ

SEQ ID NO: 4001 - protein, 536 aa, Artificial Sequence
  VP1__Norovirus_and/or_Norovirus-like__KF806495
MKMASNDANPSDGSAANLVPEVNNEVMALEPVVGAAIAAPVAGQQNVIDPWIRNNFVQAPGGEFTISPRNAPGEILWSAPLGPDLNPYLSHLARMYNGYAGGFEVQVVLAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPVLTVEEMTNSRFPIPLEKLFTGPSSAFVVQPQNGRCTTDGVLLGTTQLSAVNICTFRGDVTHVSDKTFAMNLASPNWNNYDPTEDIPAPLGTPDFVGRIHGMLTQTTRRDGATRGHKATVSTGGADFTPKLGSVRYITDTTDDLEVRENTKFTPIGVLHSSGEHRAEPDQWRLPEYSGRNVHNVHLAPAVAPTFPGEQLLFFRSALPGCGGYPNTDLDCLLPQEWVQHFYQEAAPAQSDVALLRFVNPDTGRVLFECKLHKSGYVTVAHTGPHDLVIPPNGYFRFDSWVNQFYTLAPMGNGTGRRR

SEQ ID NO: 4002 - protein, 536 aa, Artificial Sequence
  VP1__Norovirus_and/or_Norovirus-like__KF806503
MKMASNDANPSDGSAANLVPEVNNEVMALEPVVGAAIAAPVAGQQNVIDPWIRNNFVQAPGGEFTISPRNAPGEILWSAPLGPDLNPYLSHLARMYNGYAGGFEVQVVLAGNAFTAGKIIFAAVPPNFPTEGLSPSQVTMFPHIIVDVRQLEPVLIPLPDVRNNFYHYNQSNDSIIKLIAMLYTPLRANNAGDDVFTVSCRVLTRPSPDFDFIFLVPPTVESRTKPFTVPVLTVDEMTNSRFPIPLEKLFTGPSSAFVVQPQNGRCTTDGVLLGTTQLSAVNICTFRGDVTHVSDKTFAMNLASPNWNNYDPTEEIPAPLGTPDFVGRIHGMLTQTTRRDGATRGHKATVSTGGADFTPKLGSVRYITDTTDDLEVRENTKFTPIGVLHSSGEHRAEPDQWRLPEYSGRNVHNVHLAPAVAPTFPGEQLLFFRSALPGCGGYPNTDLDCLLPQEWVQHFYQEAAPAQSDVALLRFVNPDTGRVLFECKLHKSGYVTVAHTGPHDLVIPPNGYFRFDSWVNQFYTLAPMGNGTGRRR

SEQ ID NO: 4003 - protein, 536 aa, Artificial Sequence
  VP1__Norovirus_and/or_Norovirus-like__KF712506
MKMASSDANPSDGSTANLVPEANNEVMALEPVVGAAIAAPVAGQQNVIDPWIRNNFVQAPGGEFTVSPRNAPGEVLWSAPLGPDLNPYLSHLARMYNGYAGGFEVQVILAGNAFAAGKIIFAAVPPNFSTEGLSPSQVTMFPHLIVDVRQLEPVMIPLPDIRNNFYHYNQSNDPTIKLIAMLYTPLRANNVGDDVFTVSCRVLTRPSPDFDFIFLVPPTVESKTNPFSVPILTIEEMTNSRFPIPLEKLFTGPSSALVVQPQNGRCTTDGVLLGTTQLSPVNICTFRGDVTHTTKTHTYQMNLAAQNWNSYDPTEEIPAPLGTPDFVGKIQGVLTQTTKENGSTRAHKATVYTGTVEFTPKLGRIQLFTDTDNDLEANQNTKFTPVGVIQDGDHQNEPQQWVLPSYSGRNNHNVHLAPAVAPTFPGEQLLFFRSTMPGCSGYPNMNLDCLLPQEWVQYFYQEAAPAQSDVALLRFVNPDTGRVLFECKLHKSGYVTVAHTGHHDLVIPPNGYFRFDSWVSPFYTLAPMGNGTGRRR

SEQ ID NO: 4004 - protein, 536 aa, Artificial Sequence
  VP1__Norovirus_and/or_Norovirus-like__KF712507
MKMASSDANPSDGSTANLVPEANNEVMALEPVVGAAIAAPVAGQQNVIDPWIRNNFVQAPGGEFTVSPRNAPGEVLWSAPLGPDLNPYLSHLARMYNGYAGGFEVQVILAGNAFAAGKIIFAAVPPNFSTEGLSPSQVTMFPHLIVDVRQLEPVMIPLPDIRNNFYHYNQSNDPTIKLIAMLYTPLRANNVGDDVFTVSCRVLTRPSPDFDFIFLVPPTVESKTNPFSVPILTIEEMTNSRFPIPLEKLFTGPSSALVVQPQNGRCTTDGVLLGTTQLSPVNICTFRGDVTHTTKTHTYQMNLAAQNWNSYDPTEEIPAPLGTPDFVGKIQGVLTQTTKGNGSTRAHKATVYTGTVEFTPKLGRIQLFTDTDNDLEANQNTKFTPVGVIQDGDHQNEPQQWVLPSYSGRNNHNVHLAPAVAPTFPGEQLLFFRSTMPGCSGYPNMNLDCLLPQEWVQYFYQEAAPAQSDVALLRFVNPDTGRVLFECKLHKSGYVTVAHTGHHDLVIPPNGYFRFDSWVSPFYTLAPMGNGTGRRR

SEQ ID NO: 4005 - protein, 536 aa, Artificial Sequence
  VP1__Norovirus_and/or_Norovirus-like__JX401281
MKMASNDANPSDGSAANLVPEVNNEVMALEPVVGAAIAAPVAGQQNVIDPWIRNNFVQAPGGEFTVSPRNAPGEILWSMPLSPELNPYLSHLSRMYNGYAGGFEVQVILAGNAFTAGKIIFAAIPPNFPTDGLSPSQVTMFPHIIVDVRQLEPVLIPLPDVRNNFYHYNQANDSTLKLIAMLYTPLRANNAGDDVFTVSCRVLTRPSPDFDFIFLVPPTVESRTKPFTVPILTVDEMTNSRFPTPLEKLHTGPNNSIVVQPQNGRCTIDGVLLGTTQLSTVNICNFRGSTTRAGQSHAYTMNLVSQNWNNYDPTEEIPAPLGTPDFVGKIVGMLSQTTRENSSTRAHKATVSTGDAHFTPKSGSVLFTTDTDDLQNGQNTRFTPVGVAQDGEPHQNEPQQWRLPNYSGTPGHNVHLAPPVAPTFPGEQLLFFRSTMPGCGGYPNMDLDCLLPQEWVRHFYQEAAPAQSDVALLRFVNPDTGRVLFECKLHKAGYITVSHTGPYDLVIPPNGYFRFDSWVNQFYALAPMGTGTGRRR

SEQ ID NO: 4006 - protein, 536 aa, Artificial Sequence
  VP1__Norovirus_and/or_Norovirus-like__KF806526
MKMASNDASPSDGSAANLVPEVNNEVMALEPVVGAAIAAPVAGQQNVIDPWIRNKFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSKDPTIKLIAMLYTPLRANNAGEDVFTVSCRVLTRPSPDFDFIFLVPPTVESRSKPFTVPILTVEEMTNSRFPIPLEKLFTGPSGAFVVQPQNGRCTTDGVLLGTTQLSPVNICTFRGDLTHFAGTHEYAMNLASQNWNNYDPTEEIPAPLGAPDFVGKIRGVLTQTTRRDGSTRGHRATLSTGSAHFTPKLGSIRFSTDTNNDFEAGQNTKFTPVGVFQDGDNHQNEPQQWVLPNYSGATAHNVHLAPAVAPAFPGEQLLFFRSTMPGCSGYPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRR

SEQ ID NO: 4007 - protein, 536 aa, Artificial Sequence
  VP1__Norovirus_and/or_Norovirus-like__KF806500
MKMASNDANPSDGSAANLVPEVNNEVMALEPVVGAAIAAPVAGQQNVIDPWIRNNFVQAPGGEFTISPRNAPGEILWSAPLGPDLNPYLSHLARMYNGYAGGFEVQVVLAGNAFTAGKVIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSAVNICTFRGDVTHVAGDTFAMNLASLNWNNYDPTEETPAPLGTPDFVGRIHGMLTQTTRSDGATRAHKATVSTGGADFTPKLGSVRYSTDTSSDLEVRENTKFTPIGVLHSSGGHRAEPDQWRLPEYSGRNVHNVHLAPAVAPTFPGEQLLFFRSTMPGCGGYPNMDLDCLLPQEWVQHFYQEAAPAQSDVALLRFVNPDTGRVLFECKLHKSGYVTVAHTGPHDLVIPPNGYFRFDSWVNQFYTLAPMGNGTGRRR

SEQ ID NO: 4008 - protein, 536 aa, Artificial Sequence
  VP1__Norovirus_and/or_Norovirus-like__KF806498
MKMASNDANPSDGSAANLVPEVNNEVMALEPVVGAAIAAPVAGQQNVIDPWIRNNFVQAPGGEFTISPRNAPGEILWSAPLGPDLNPYLSHLARMYNGYAGGFEVQVVLAGNAFTAGKIIFAAVPPNFPTEGLSPSQVTMFPHIIVDVRQLEPVLIPLPDVRNNFYHYNQSKDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSAVNICTFRGDVTHVAGDTFAMNLASLNWNNYDPTEETPAPLGTPDFVGRIHGMLTQTTRSDGATRAHKATVSTGGADFTPKLGSVRYSTDTSSDLEVRENTKFTPIGVLHSSGGHRAEPDQWRLPEYSGRNVHNVHLAPAVAPTFPGEQLLFFRSTMPGCGGYPNMDLDCLLPQEWVQHFYQEAAPAQSDVALLRFVNPDTGRVLFECKLHKSGYVTVAHTGPHDLVIPPNGYFRFDSWVNQFYTLAPMGNGTGRRR

SEQ ID NO: 4009 - protein, 536 aa, Artificial Sequence
  VP1__Norovirus_and/or_Norovirus-like__KF429768
MKMASSDANPSDGSTANLVPEANNEVMALEPVVGAAIAAPVAGQQNVIDPWIRNNFVQAPGGEFTVSPRNAPGEVLWSAPLGPDLNPYLSHLARMYNGYAGGFEVQVILAGNAFAAGKIIFAAVPPNFSTEGLSPSQVTMFPHLIVDVRQLEPVMIPLPDIRNNFYHYNQSNDPTIKLIAMLYTPLRANNVGDDVFTVSCRVLTRPSPDFDFIFLVPPTVESKTNPFSVPILTIEEMTNSRFPIPLEKLFTGPSSALVVQPQNGRCTTDGVLLGTTQLSPVNICTFRGDVTHTTKTHTYQMNLAAQNWNSYDPTEETPAPLGTPDFVGKIQGVLTQTTKGNGSTRAHKATVYTGTVEFTPKLGRIQLFTDTDNDLEANQNTKFTPVGVIQDGDHQNEPQQWVLPSYSGRNNHNVHLAPAVAPTFPGEQLLFFRSTMPGCSGYPNMNLDCLLPQEWVQYFYQEAAPAQSDVALLRFVNPDTGRVLFECKLHKSGYVTVAHTGHHDLVIPPNGYFRFDSWVSPFYTLAPMGNGTGRRR

SEQ ID NO: 4010 - protein, 536 aa, Artificial Sequence
  VP1__Norovirus_and/or_Norovirus-like__KF806496
MKMASNDANPSDGSAANLVPEVNNEVMALEPVVGAAIAAPVAGQQNVIDPWIRNNFVQAPGGEFTISPRNAPGEILWSAPLGPDLNPYLSHLARMYNGYAGGFEVQVVLAGNAFTAGKIIFAAVPPNFPTEGLSPSQVTMFPHIIVDVRQLEPVLIPLPDVRNNFYHYNQSKDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSAVNICTFRGDVTHVAGDTFAMNLASLNWNNYDPTEETPAPLGTPDFVGRIHGMLTQTTRSDGATRAHKATVSTGGADFTPKLGSVRYSTDTSGDLEVRENTKFTPIGVLHSSGERRAEPEQWRLPEYSGRNVHNVHLAPAVAPTFPGEQLLFFRSTMPGCGGYPNMDLDCLLPQEWVQHFYQEAAPAQSDVALLRFVNPDTGRVLFECKLHKSGYVTVAHTGPHDLVIPPNGYFRFDSWVNQFYTLAPMGNGTGRRR

SEQ ID NO: 4011 - protein, 536 aa, Artificial Sequence
  VP1__Norovirus_and/or_Norovirus-like__KF806499
MKMASNDANPSDGSAANLVPEVNNEVMALEPVVGAAIAAPVAGQQNVIDPWIRNNFVQAPGGEFTISPRNAPGEILWSAPLGPDLNPYLSHLARMYNGYAGGFEVQVVLAGNAFTAGKIIFAAVPPNFPTEGLSPSQVTMFPHIIVDVRQLEPVLIPLPDVRNNFYHYNQSKDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSAVNICTFRGDVTHVAGDTFAMNLASLNWNNYDPTEETPAPLGTPDFVGRIHGMLTQTTRSDGATRAHKATVSTGGADFTPKLGSVRYSTDTSSDLEVRENTKFTPIGVLHSSGGHRAEPDQWRLPEYSGRNVHNVHLAPAVAPTFPGEQLLFFRSTMPGCGGYPNMDLDCLLPQEWVQHFYQETAPAQSDVALLRFVNPDTGRVLFECKLHKSGYVTVAHTGPHDLVIPPNGYFRFDSWVNQFYTLAPMGNGTGRRR

SEQ ID NO: 4012 - protein, 536 aa, Artificial Sequence
  VP1__Norovirus_and/or_Norovirus-like__KF806497
MKMASSDANPSDGSAANLVPEVNNEVMALEPVVGAAIAAPVAGQQNVIDPWIRNNFVQAPGGEFTISPRNAPGEILWSAPLGPDLNPYLSHLARMYNGYAGGFEVQVVLAGNAFTAGKIIFAAVPPNFPTEGLSPSQVTMFPHIIVDVRQLEPVLIPLPDVRNNFYHYNQSKDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSAVNICTFRGDVTHVAGDTFAMNLASLNWNNYDPTEETPAPLGTPDFVGRIHGMLTQTTRSDGATRAHKATVSTGGADFTPKLGSVRYSTDTSSDLEVRENTKFTPIGVLHSSGGHRAEPDQWRLPEYSGRNVHNVHLAPAVAPTFPGEQLLFFRSTMPGCGGYPNMDLDCLLPQEWVQHFYQEAAPAQSDVALLRFVNPDTGRVLFECKLHKSGYVTVAHTGPHDLVIPPNGYFRFDSWVNQFYTLAPMGNGTGRRR

SEQ ID NO: 4013 - protein, 536 aa, Artificial Sequence
  VP1__Norovirus_and/or_Norovirus-like__JN699046
MMMASKDASPSADGANGAGQLVPEVNNAEPLPLDPVAGASTALATAGQVNMIDPWIFNNFVQAPQGEFTISPNNTPGDILFDLQLGPHLNPFLAHLSQMYNGWVGNMRVRVILAGNAFTAGKVIICCVPPGFQSRTLSIAQATLFPHIIADVRTLEPIEIPLEDVRNTLYHTNDNQPTMRLLCMLYTPLRTGGGSGGTDAFVVAGRVLTCPSSDFNFLFLVPPTVEQKTRPFSVPNIPLQLLSNSRVPNLIQSMVLSPDQAQNVQFQNGRCTTDGQLLGTTPVSVSQILKFRGKVSAGSRVINLTELDGSPFLAFEAPAPTGFPDLGTSDWHVEMSLNSNSQSSGNPILLRDIQPNSSDFVPHLGSVSVTTAIDVAGDYTGTIQWTSQPSNVTPVPDVNFWTIPQYGSNLAEASQLAPVVYPPGFGEAIVYFMSPIPGPNTAHKPNLVPCLLPQEFVTHFVSEQAPSMGEAALVHYVDPDTNRNLGEFKLYPEGFITCVPNGTGPQQLPLNGVFVFASWVSRFYQLKPVGTASSAR

SEQ ID NO: 4014 - protein, 536 aa, Artificial Sequence
  VP1__Norovirus_and/or_Norovirus-like__AM263418
MMMASKDASPSADGANGAGQLVPEVNNAEPLPLDPVAGASTALATAGQVNMIDPWIFNNFVQAPQGEFTISPNNTPGDILFDLQLGPHLNPFLAHLSQMYNGWVGNMRVRVILAGNAFTAGKVIVCCVPPGFQSRTLSIAQATLFPHIIADVRTLEPIEIPLEDVRNTLYHTNDNQPTMRLLCMLYTPLRTGGGSGGTDAFVVAGRVLTCPSSDFNFLFLVPPTVEQKTRPFSVPNIPLQLLSNSRVPNLIQSMVLSPDQAQNVQFQNGRCTTDGQLLGTTPVSVSQILKFRGKVSAGSRVINLTELDGSPFLAFEAPAPTGFPDLGTSDWHVEMSLNSNSQSSGNPILLRDIQPNSSDFVPHLGSVAVTTAIDVAGDYTGTIQWTSQPSNVTPVPDVNFWTIPQYGSNLAEASQLAPVVYPPGFGEAIVYFMSPIPGPNTAHKPNLVPCLLPQEFVTHFVSEQAPSMGEAALVHYVDPDTNRNLGEFKLYPEGFITCVPNGTGPQQLPLNGVFVFASWVSRFYQLKPVGTASSAR

SEQ ID NO: 4015 - protein, 536 aa, Artificial Sequence
  VP1__Norovirus_and/or_Norovirus-like__KT732278
MMMASKDATPSADGANGAGQLVPEVNNAEPLPLDPVAGASTALATAGQVNMIDPWIFNNFVQAPQGEFTISPNNTPGDILFDLQLGPHLNPFLAHLSQMYNGWVGNMRVRVILAGNAFTAGKVIICCVPPGFQSRTLSIAQATLFPHIIADVRTLEPIEIPLEDVRNTLYHTNDNQPTMRLLCMLYTPLRTGGGSGGTDAFVVAGRVLTSPSPDFNFLFLVPPTVEQKTRPFSVPNIPLQLLSNSRVPNLIQSMVLSPDQAQNVQFQNGRCTTDGQLLGTTPVSVSQILKFRGKVSAGSKVINLTELDGSPFLAFEAPAPTGFPDLGTSDWHIEMSLNSNSQSSGNPILLRDIQPNSSDFVPHLGSVAVTTAIDTAGDYTGTIQWTSQPSNVTPVPDVNFWTIPQYGSNLAEASQLAPVVYPPGFGEAIVYFMSPIPGPNTAHKPNLVPCLLPQEFVTHFVSEQAPSMGEAALVHYVDPDTNRNLGEFKLYPEGFITCVPNGTGPQQLPLNGVFVFASWVSRFYQLKPVGTANSAR

SEQ ID NO: 4016 - protein, 536 aa, Artificial Sequence
  VP1__Norovirus_and/or_Norovirus-like__KT732277
MMMASKDATPSADGANGAGQLVPEVNNAEPLPLDPVAGASTALATAGQVNMIDPWIFNNFVQAPQGEFTISPNNTPGDILFDLQLGPHLNPFLAHLSQMYNGWVGNMRVRVILAGNAFTAGKVIICCVPPGFQSRTLSIAQATLFPHIIADVRTLEPIEIPLEDVRNTLYHTNDNQPTMRLLCMLYTPLRTGGGSGGTDAFVVAGRVLTSPSPDFNFLFLVPPTVEQKTRPFSVPNIPLQLLSNSRVPNLIQSMVPSPDQAQNVQFQNGRCTTDGQLLGTTPVSVSQILKFRGKVSAGSKVINLTELDGSPFLAFEAPAPTGFPDLGTSDWHIEMSLNSNSQSSGNPILLRDIQPNSSDFVPHLGSVAVTTAIDTAGDYTGTIQWTSQPSNVTPVPDVNFWTIPQYGSNLAEASQLAPVVYPPGFGEAIVYFMSPIPGPNTAHKPNLVPCLLPQEFVTHFVSEQAPSMGEAALVHYVDPDTNRNLGEFKLYPEGFITCVPNGTGPQQLPLNGVFVFASWVSRFYQLKPVGTANSAR

SEQ ID NO: 4017 - protein, 536 aa, Artificial Sequence
  VP1__Norovirus_and/or_Norovirus-like__KJ402295
MMMASKDAPSSADGANGAGQLVPEVNNAEPLPLDPVAGASTALATAGQVNMIDPWIFNNFVQAPQGEFTISPNNTPGDILFDLQLGPHLNPFLAHLSQMYNGWVGNMRVRVILAGNAFTAGKVIICCVPPGFQSRTLSIAQATLFPHIIADVRTLEPIEIPLEDVRNTLYHTNDNQPTMRLLCMLYTPLRTGGGSGGTDAFVVAGRVLTCPSSDFNFLFLVPPTVEQKTRPFSVPNIPLQLLSNSRVPNLIQSMVLSPDQAQNVQFQNGRCTTDGQLLGTTPVSVSQILKFRGKVSAGSKVINLTELDGSPFLAFEAPAPTGFPDLGTSDWHVEMSLNSNSQSSGNPILLRDIHPNSSEFVPHLGSVCVTAAIEVAGDYTGTIQWTSQPSNVTPVPDVNFWTIPHYGSNLAEASQLAPVVYPPGFGEAIVYFMSPIPGPNTAHKPNLVPCLLPQEFVTHFVSEQAPSMGEAALVHYVDPDTNRNLGEFKLYPEGFITCVPNGTGPQQLPLNGVFVFASWVSRFYQLKPVGTASSAR

SEQ ID NO: 4018 - protein, 536 aa, Artificial Sequence
  VP1__Norovirus_and/or_Norovirus-like__AF414406
MMMASKDASPSADGANGAGQLVPEVNNAEPLPLDPVAGASTALATAGQVNMIDPWIFNNFVQAPQGEFTISPNNTPGDILFDLQLGPHLNPFLAHLSQMYNGWVGNMRVRVILAGNAFTAGKVIVCCVPPGFQSRTLSIAQATLFPHIIADVRTLEPIEIPLEDVRNTLYHTNDNQPTMRLLCMLYTPLRTGGGSGGTDAFVVAGRVLTCPSSDFNFLFLVPPTVEQKTRPFSVPNIPLQLLSNSRVPNLIQSMVPSPDQAQNVQFQNGRCTTDGQLLGTTPVSVSQILKFRGKVSAGSRVINLTELDGSPFLAFEAPAPTGFPDLGTSDWHVEMSLNSNSQSSGNPILLRDIQPNSSDFVPHLGSVAVTTAIDVAGDYTGTIQWTSQPSNVTPVPDVNFWTIPQYGSNLAEASQLAPVVYPPGFGEAIVYFMSPIPGPNTAHKPNLVPRLLPQEFVTHFVSEQAPSMGEAALVHYVDPDTNRNLGEFKLYPEGFVTCMPNGTGPQQLPLNGVFVFASWVSRFYQLKPVGTASSAR

SEQ ID NO: 4019 - protein, 536 aa, Artificial Sequence
  VP1__Norovirus_and/or_Norovirus-like__AB039774
MMMASKDATPSADGANGAGQLVPEVNNAEPLPLDPVAGASTALATAGQVNMIDPWIFNNFVQAPQGEFTISPNNTPGDILFDLQLGPHLNPFLAHLSQMYNGWVGNMRVRVILAGNAFTAGKVIICCVPPGFQSRTLSIAQATLFPHVIADVRTLEPLEIPLEDVRNTLYHNNDSQPTMRLLCMLYTPLRTGGGSGGTDAFVVAGRVLTCPSPDFNFLFLVPPTVEQKTRPFSVPNIPLQNLSNSRVPSLIQSMVLSNDHAQTVQFQNGRCTTDGHLLGTTPVSAGQLMKFRGKVTSGSKVLNLTELDGSPFLAFEAPAPAGFPDLGKCDWHVEMSLYQDNNHADPIVLHAIEPNSSSFVPHLGSVSFKENVNVAGDYVCTIQYTSPPSDPHNPNADVDFWSIPDYGSNLAEASQLAPVVYPPGFGEAIVYFMSRVPGWNRTNRLNLVPCLLPQEFIGHFVSEQAPAIGEAALLHYVDPDTNRNLGEFKLYPEGFITCVPNGTGPQQLPLNGVFVFSSWVSRFYQLKPVGTASLAR

SEQ ID NO: 4020 - protein, 536 aa, Artificial Sequence
  VP1__Norovirus_and/or_Norovirus-like__KP064095
MASKDAPQSADGASGAGQLVPEVNTADPLPMEPVAGPTTAVATAGQVNMIDPWIVNNFVQSPQGEFTISPNNTPGDILFDLQLGPHLNPFLSHLSQMYNGWVGNMRVRILLAGNAFSAGKIIVCCVPPGFTSSSLTIAQATLFPHVIADVRTLEPIEMPLEDVRNVLYHTNDNQPTMRLVCMLYTPLRTGGGSGNSDSFVVAGRVLTAPSSDFSFLFLVPPTIEQKTRAFTVPNIPLQTLSNSRFPSLIQGMILSPDASQVVQFQNGRCLIDGQLLGTTPATSGQLFRVRGKINQGARTLNLTEVDGKPFMAFDSPAPVGFPDFGKCDWHMRISKTPNNTSSGDPMRSVSVQTNVQGFVPHLGSIQFDEVFNHPTGDYIGTIEWISQPSTPPGTDINLWEIPDYGSSLSQAANLAPPVFPPGFGEALVYFVSAFPGPNNRSAPNDVPCLLPQEYITHFVSEQAPTMGDAALLHYVDPDTNRNLGEFKLYPGGYLTCVPNGVGAGPQQLPLNGVFLFVSWVSRFYQLKPVGTASTAR

SEQ ID NO: 4021 - protein, 535 aa, Artificial Sequence
  VP1__Norovirus_and/or_Norovirus-like__AB045603
MKMASSDAAPSNDGAAGLVPEANNETMALEPVAGASIAAPLTGQNNIIDPWIRLNFVQAPNGEFTVSPRNSPGEVLLNLELGPELNPYLAHLSRMYNGYAGGVEVQVLLAGNAFTAGKLVFAAVPPHFPLENISPGQITMFPHVIIDVRTLEPVLLPLPDVRNNFFHYNQQNEPRMRLVAMLYTPLRSNGSGDDVFTVSCRVLTRPSPDFDFNYLVPPTVESKTKPFTLPILTIGELTNSRFPVPIDELYTSPNESLVVQPQNGRCALDGELQGTTQLLPTAICSFRGRINQKVSGENHVWNMQVTNINGTPFDPTEDVPAPLGTPDFSGKLFGVLSQRDHDNACRSHDAVIATNSAKFTPKLGAIQIGTWEEDDVHINQPTKFTPVGLFENEGFNQWTLPNYSGALTLNMGLAPPVAPTFPGEQILFFRSHIPLKGGVADPVIDCLLPQEWIQHLYQESAPSQSDVALIRFTNPDTGRVLFEAKLHRSGYITVANTGSRPIVVPANGYFRFDSWVNQFYSLAPMGTGNGRRRVQ

SEQ ID NO: 4022 - protein, 535 aa, Artificial Sequence
  VP1__Norovirus_and/or_Norovirus-like__AF397905
MKMASSDAAPSNDGAAGLVPEANNETMALEPVAGASIAAPLTGQNNIIDPWIRLNFVQAPNGEFTVSPRNSPGEVLLNLELGPELNPYLAHLSRMYNGYAGGVEVQVLLAGNAFTAGKLVFAAVPPHFPLENISPGQITMFPHVIIDVRTLEPVLLPLPDVRNNFFHYNQQNEPRMRLVAMLYTPLRSNGSGDDVFTVSCRVLTRPSPDFDFNYLVPPTVESKTKPFTLPILTIGELTNSRFPVPIDELYTSPNESLVVQPQNGRCALDGELQGTTQLLPTAICSFRGRINQKVSGENHVWNMQVTNINGTPFDPTEDVPAPLGTPDFSGKLFGVLSQRDHDNACRSHDAVIATNSAKFTPKLGAIQIGTWEQDDVHINQPTKFTPVGLFENEGFNQWTLPNYSGALTLNMGLAPPVAPTFPGEQILFFRSHIPLKGGVADPVIDCLLPQEWIQHLYQESAPSQSDVALIRFTNPDTGRVLFEAKLHRSGYITVANTGSRPIVVPANGYFRFDSWVNQFYSLAPMGTGNGRRRVQ

SEQ ID NO: 4023 - protein, 535 aa, Artificial Sequence
  VP1__Norovirus_and/or_Norovirus-like__AF414420
MKMASSDAAPSNDGAAGLVPEANNETMALEPVAGASIAAPLTGQNNIIDPWIRLNFVQAPNGEFTVSPRNSPGEVLLNLELGPELNPYLAHLSRMYNGYAGGVEVQVLLAGNAFTAGKLVFAAVPPHFPLENISPGQIAMFPHVIIDVRTLEPVLLPLPDVRNNFFHYNQQNEPRMRLVAMLYTPLRSNGSGDDVFTVSCRVLTRPSPDFDFNYLVPPTVESKTKPFTLPILTIGELTNSRFPVPIDELYTSPNESLVVQPQNGRCVLDGELQGTTQLLPTAICSFRGRINQKVSGENHVWNMQVTNINGTPFDPTEDVPAPLGTPDFSGKLFGVLSQRDHDNACRSHDAVIATNSAKFTPKLGAIQIGTWEEDDVHINQPTKFTPVGLFENEGFNQWTLPNYSGALTLNMGLAPPVAPTFPGEQILFFRSHIPLKGGVADPVIDCLLPQEWIQHLYQESAPSQSDVALIRFTNPDTGRVLFEAKLHRSGYITVANTGSRPIVVPANGYFRFDSWVNQFYSLAPMGTGNGRRRVQ

SEQ ID NO: 4024 - protein, 535 aa, Artificial Sequence
  VP1__Norovirus_and/or_Norovirus-like__AF427119
MKMASSDAAPSNDGAAGLVPEANNETMALEPVAGASIAAPLTGQNNVIDPWIRLNFVQAPNGEFTVSPRNSPGEILLNLELGPELNPYLAHLSRMYNGYAGGVEVQVLLAGNAFTAGKLVFAAVPPHFPLENISPGQITMFPHVIIDVRTLEPVLLPLPDVRNSFFHYNQQNEPRMRLVAMLYTPLRSNGSGDDVFTVSCRVLTRPSPDFDFNYLVPPTVESKTKPFTLPILTIGELTNSRFPAPIDELYTSPNESLVVQPQNGRCALDGELQGTTQLLPTAICSFRGRINQKVSGENHIWNMQVTNTNGTPFDPTEDVPAPLGTPDFSGRLFGVLSQRDHDNACRSHDAVIATNSAKFTPKLGAIQIGTWEEDDVHINQPTKFTPVGLFEHGDFNQWTLPNYSGALTLNMGLAPPVAPTFPGEQILFFRSHIPLKGGVADPVIDCLLPQEWIQHLYQESAPSQSDVALIRFTNPDTGRVLFEAKLHRSGYITVANTGSRPIVVPANGYFRFDSWVNQFYSLAPMGTGNGRRRVQ

SEQ ID NO: 4025 - protein, 535 aa, Artificial Sequence
  VP1__Norovirus_and/or_Norovirus-like__AB044366
MKMASSDAAPSNDGAAGLVPEANNETMALEPVAGASIAAPLTGQNNIIDPWIRLNFVQAPNGEFTVSPRNSPGEVLLNLELGPELNPYLAHLSRMYNGYAGGVEVQVLLAGNAFTAGKLVFAAVPPHFPLENISPGQITMFPHVIIDVRTLEPVLLPLPDVRNNFFHYNQQNEPRMRLVAMLYTPLRSNGSGDDVFTVSCRVLTRPSPDFDFNYLVPPTVESKTKPFTLPILTIGELTNSRFPVPIDELYTSPNESLVVQPQNGRCALDGELQGTTQLLPTAICSFRGRINQKVSGENHVWNMQVTNINGTPFDPTEDVPAPLGTPDFSGKLFGVLSQRDHDNACRSHDAVIATNSAKFTPKLGAIQIGTWEEDDVHINQPTKFTPVGLFEDGGFNQWTLPNYSGALTLNMGLAPPVAPTFPGEQILFFRSHIPLKGGVADPVIDCLLPQEWIQHLYQESAPSQSDVALIRFTNPDTGRVLFEAKLHRSGYITVANTGSRPIVVPANGYFRFDSWVNQFYSLAPMGTGNGRRRVQ

SEQ ID NO: 4026 - protein, 535 aa, Artificial Sequence
  VP1__Norovirus_and/or_Norovirus-like__AB032758
MKMASNDAAPSNDGAAGLVPEANNETMALEPVAGASIAAPLTGQNNIIDPWIRLNFVQAPNGEFTVSPRNSPGEVLLNLELGPELNPYLAHLSRMYNGYAGGVEVQVLLAGNAFTAGKLVFAAVPPHFPLENISPGQITMFPHVIIDVRTLEPVLLPLPDVRNNFFHYNQQNEPRMRLVAMLYTPLRSNGSGDDVFTVSCRVLTRPSPDFDFNYLVPPTLESKTKPFTLPILTIGELTNSRFPVPIDELYTSPNESLVVQPQNGRCALDGELQGTTQLLPTAICSFRGRINQKVSGENHVWNMQVTNINGTPFDPTGDVPAPLGTPDFSGKLFGVLSQRDHDNACRSHDAVIATNSAKFTPKLGAIQIGTWEEDDVHINQPTKFTPVGLFENEGFNQWTLPNYSGALTLNMGLAPPVAPTFPGEQILFFRSHIPLKGGVADPVIDCLLPQEWIQHLYQESAPSQSDVALIRFTNPDTGRVLFEAKLHRSGYITVANTGSRPIVVPANGYFRFDTWVNQFYSLAPMGTGNGRRRVQ

SEQ ID NO: 4027 - protein, 535 aa, Artificial Sequence
  VP1__Norovirus_and/or_Norovirus-like__AB039775
MKMASSDAAPSNDGAAGLVPEANNETMALEPVAGASIAAPLTGQNNIIDPWIRLNFVQAPNGEFTVSPRNSPGEVLLNLELGPELNPYLAHLSRMYNGYAGGVEVQVLLAGNAFTAGKLVFAAVPPHFPLENISPGQITMFPHVIIDVRTLEPVLLPLPDVRNNFFHYNQQNEPRMRLVAMLYTPLRSNGSGDDVFTVSCRVLTRPSPDFDFNYLVPPTVESKTKPFTLPTLTIGELTNSRFPVPIDELYTSPNESLVVQPQNGRCALDGELRGTTQLLPTAICPFRGRINQKVSGENHVWNMQVTNINGTPFDPTEDVPAPLGTPDFSGKLFGVLSQRDHDNACRSHDAVIATNSAKFTPKLGAIQIGTWEEDDVHINQPTKFTPVGLFENEGFNQWTLPNYSGALTLNMGLAPPVAPTFPGERILFFRSHIPLKGGVADPVIDCLLHQEWIQHLYQESAPSQSDVALIRFTNPDTGRVLFEAKLHRSGYITVANTGSRPIVVPANGYFRFDSWVNQFYSLAPMGTGNGRRRVQ

SEQ ID NO: 4028 - protein, 535 aa, Artificial Sequence
  VP1__Norovirus_and/or_Norovirus-like__AF414418
MKMASNDAAPSNDGAAGLVPEVNNETMALEPVAGASIAAPLTGQNNVIDPWIRMNFVQAPNGEFTVSPRNSPGEILLNLELGPGLNPFLAHLSRMYNGYAGGVEVQVLLAGNAFTAGKLVFAAIPPHFPIENLSPGQITMFPHVIIDVRTLEPVLLPLPDVRNNFFHYNQEPEPRMRLVAMLYTPLRSNGSGDDVFTVSCRVLTRPSPDFDFNYLVPPTVESKTKPFTLPILTIGELSNSRFPAPIDELYTSPNEGLVVQPQNGRSTLDGELLGTTQLVPSNICSLRGRINAHLSDNQHRWNMQVTNANGTPFDPTEDVPAPLGTPDFLANIYGVTSQRNPDNTCRAHDGILATWSPKFTPKLGSVVLGTWEDRDFDINQPTRFTPVGLYDTDHFNQWALPNYSGALTLNMNLAPSVAPLFPGEQLLFFRSHIPLKGGTSNGAIDCLLPQEWVQHFYQESAPSSTDVALIRYTNPDTGRVLFEAKLHRQGFITVANSGSRPIVVPPNGYFRFDSWVNQFYSLAPMGTGNGRRRVQ

SEQ ID NO: 4029 - protein, 535 aa, Artificial Sequence
  VP1__Norovirus_and/or_Norovirus-like__AF425769
MKMASNDAAPSNDGAAGLVPEVNNETMALEPVAGASIAAPLTGQNNVIDPWIRMNFVQAPNGEFTVSPRNSPGEILLNLELGPELNPFLAHLSRMYNGYAGGVEVQVLLAGNAFTAGKLVFAAIPPHFPIENLSPGQITMFPHVIIDVRTLEPVLLPLPDVRNNFFHYNQEPEPRMRLVAMLYTPLRSNGSGDDVFTVSCRVLTRPSPDFDFNYLVPPTVESKTKPFTLPILTIGELSNSRFPAPIDELYTSPNEGLVVQPQNGRSTLDGELLGTTQLVPSNICSLRGRINAHLSDNQHRWNMQVTNVNGTPFDPTEDVPAPLGTPDFLANIYGVTSQRNPDNTCRAHDGILATWSPKFTPKLGSVVLGTWEDRDFDINQPTRFTPVGLYDTDHFNQWALPNYSGALTLNMNLAPSVAPLFPGEQLLFFRSHIPLKGGTSNGAIDCLLPQEWVQHFYQESAPSSTDVALIRYTNPDTGRVLFEAELHRQGFITVANPGSRPIVVPPNGYFRFDSWVNQFYSLAPMGTGNGRRRVQ

SEQ ID NO: 4030 - protein, 535 aa, Artificial Sequence
  VP1__Norovirus_and/or_Norovirus-like__AF414421
MKMASNDAAPSNDGAAGLVPEVNNETMALEPVAGASIAAPLTGQNNVIDPWIRMNFVQAPNGEFTVSPRNSPGEILLNLELGPELNPFLAHLSRMYNGYAGGVEVQVLLAGNAFTAGKLVFAAIPPHFPIENLSPGQITMFPHVIIDVRTLEPVLLPLPDVRNNFFHYNQEPEPRMRLVAMLYTPLRSNGSGDDVFTVSCRVLTRPSPDFDFNYLVPPTVESKTKPFTLPILTIGELSNSRFPAPIDELYTSPNEGLVVQPQNGRPTLDGELLGTTQLVPSNICSLRGRINAHLSDNQHRWNMQVTNANGTPFDPTEDAPAPLGTPDFLANIYGVTSQRNPDNTCRAHDGILATWSPKFTPKLGSVVLGTWEDRDFDINQPTRFTPVGLYDTDHFNQWALPNYSGALTLNMNLAPSVAPLFPGEQLLFFRSHIPLKGGTSNGAIDCLLPQEWVQHFYQESAPSSTDVALIRYTNPDTGRVLFEAKLHRQGFITVANSGSRPIVVPPNGYFRFDSWVNQFYSLAPMGTGNGRRRVQ

SEQ ID NO: 4031 - protein, 535 aa, Artificial Sequence
  VP1__Norovirus_and/or_Norovirus-like__AF414416
MKMASNDAAPSNDGAAGLVPEVNNETMALEPVAGASIAAPLTGQNNVIDPWIRMNFVQAPNGEFTVSPRNSPGEILLNLELGPELNPFLAHLSRMYNGYAGGVEVQVLLAGNAFTAGKLVFAAIPPHFPIGNLSPGQIAMFPHVIIDVRTLEPVLLPLPDVRNNFFHYNQEPEPRMRLVAMLYTPLRSNGSGDDVFTVSCRVLTRPSPDFDFNYLVPPTVESKTKPFTLPILTIGELSNSRFPVPIDELYTSPNEGLVVQPQNGRSTLDGELLGTTQLVPSNICSLRGRINAHLSDNQHRWNMQVTNANGTPFDPTEDVPAPLGTPDFLANIYGVTSQRNPDNTCRAHDGILATWSPKFTPKLGSVVLGTWEDRDFDINQPTRFTPVGLYDTDHFNQWVLPYYSGALTLNMNLAPSVAPLFPGEQLLFFRSHVPLKGGTSNGAIDCLLPQEWVQHFYQESAPSSTDVALIRYTNPDTGRVLFEAKLHRQGFITVANSGSRPIVVPPNGYFRFDSWVNQFYSLAPMGTGNGRRRVQ

SEQ ID NO: 4032 - protein, 535 aa, Artificial Sequence
  VP1__Norovirus_and/or_Norovirus-like__AF414419
MKMASNDAAPSNDGAAGLVPEVNNETMALEPVAGASIAAPLTGQNNVIDPWIRMNFVQAPNGEFTVSPRNSPGEILLNLELGPELNPFLAHLSRMYNGYAGGVEVQVLLAGNAFTAGKLVFAAIPPHFPIENLSPGQITMFPHVIIDVRTLEPVLLPLPDVRNNFFHYNQEPEPRMRLVAMLYTPLRSNGSGDDVFTVSCRVLTRPSPDFDFNYLVPPTVESKTKPFTLLILTIGELSNSRFPAPIDELYTSPNEGLVVQPQNGRSTLDGELLGTTQLVPSNICSLRGRINAHLSDNQHRWNMQVTNANGTPFDPTEDVPAPLGTPDFLANIYGVTSQRNPDNTCRAHDGILATWSPKFTPKLGSVVLGTWEDRDFDINQPARFTPVGLYDTDHFNQWALPNYSGALTLNMNLAPSVAPLFPGEQLLFFRSHIPLKGGTSNGAIDCLLPQEWVQHFYQESAPSSTDVALIRYTNPDTGRVLFEAKLHRQGFITVANSGSRPIVVPPNGYFRFDSWVNQFYSLAPMGTGNGRRRVQ

SEQ ID NO: 4033 - protein, 535 aa, Artificial Sequence
  VP1__Norovirus_and/or_Norovirus-like__AF425767
MKMASNDAAPSNDGAAGLVPEVNNETMALEPVAGASIAAPLTGQNNVIDPWIRMNFVQAPNGEFTVSPRNSPGEILLNLELGPELNPFLAHLSRMYNGYAGGVEVQVLLAGNAFTAGKLVFAAIPPHFPIENLSPGQITMFPHVIIDVRTLEPVLLPLPDVRNNFFHYNQDPEPRMRLVAMLYTPLRSNGSGDDVFTVSCRVLTRPSPDFDFNYLVPPTVESKTKPFTLPILTIGELSNSRFPAPIDELYTSPNEGLVVQPQNGGSTLDGELLGTTQLVPSNICSLRGRINAHLSDNQHRWNMQVTNVNGTPFDPTEDVPAPLGTPDFLANIYGITSQRNPDNTCRAHDGILATWSPKFTPKLGSVVLGTWEDRDFDINQPTRFTPVGLYDTDHFNQWALPNYSGALTLNMNLAPSVAPLFPGEQLLFFRSHIPLKGGTSNGAIDCLLPQEWVQHFYQESAPSSTDVALIRYTNPDTGRVLFEAKLHRQGFITVANSGSRPIVVPPNGYFRFDSWVNQFYSLAPMGTGNGRRRVQ

SEQ ID NO: 4034 - protein, 535 aa, Artificial Sequence
  VP1__Norovirus_and/or_Norovirus-like__DQ093065
MKMASNDAAPSNDGAAGLVPEVNNEMMALEPVAGASIAAPLTGQNNVIDPWIRMNFVQAPNGEFTVSPRNSPGEILLNLELGPELNPFLAHLSRMYNGYAGGVEVQVLLAGNAFTAGKLVFAAIPPRFPIENLSPGQITMFPHVIIDVRTLEPVLLPLPDVRNNFFHYNQEPEPRMRLVAMLYTPLRSNGSGDDVFTVSCRVLTRPSPDFDFNYLVPPTVESKTKPFTLPILTIGELSNSRFPAPIDELYTSPNEGLVVQPQNGRSTLDGELLGTTQLVPSNICSLRGRINAHLPDNQHRWNMQVTNANGTPFDPTEDVPAPLGTPDFLANIYGVTSQRNPDNTCRAHDGILATWSPKFTPKLGSVVLGTWEDRDFDINQPTRFTPVGLYDTDHFNQWALPNYSGALTLNMNLAPSVAPLFPGEQLLFFRSHIPLKGGTSNGAIDCLLPQEWVQHFYQESAPSSTDVALIRYTNPDTGRVLFEAKLHRQGFITVANSGSRPIVVPPNGYFRFDSWVNQFYSLAPMGTGNGRRRVQ

SEQ ID NO: 4035 - protein, 535 aa, Artificial Sequence
  VP1__Norovirus_and/or_Norovirus-like__KJ194507
MKMASNDAAPSNDGAAGLVPEVNNETMALEPVAGASIAAPLTGQNNVIDPWIRMNFVQAPNGEFTVSPRNSPGEVLLNLELGPELNPFLAHLSRMYNGYAGGVEVQVLLAGNAFTAGKLVFAAIPPHFPLENLSPGQITMFPHVIIDVRTLEPVLLPLPDVRNNFFHYNQQPEPRMRLVAMLYTPLRSNGSGDDVFTVSCRVLTRPSPDFDFNYLVPPTVESKTKPFTLPILTIGELSNSRFPVPIDELYTSPNEGVVVQPQNGRSTLDGELLGTTQLVPSNICALRGRINAQVPDDHHQWNLQVTNTNGTPFDPTEDVPAPLGTPDFLANIYGVTSQRNPNNTCRAHDGVLATWSPKFTPKLGSVVLGTWEESDLDLNQPTRFTPVGLFNTDHFDQWVLPNYSGRLTLNMNLAPSVSPLFPGEQILFFRSHIPLKGGTSDGAIDCLLPQEWIQHFYQESAPSPTDVALIRYTNPDTGRVLFEAKLHRQGFITVANSGSRPIVVPPNGYFRFDSWVNQFYSLAPMGTGNGRRRVQ

SEQ ID NO: 4036 - protein, 535 aa, Artificial Sequence
  VP1__Norovirus_and/or_Norovirus-like__KP064099
MKMASNDAAPSNDGAAGLVPEVNNETMALEPVAGASIAAPLTGQNNVIDPWIRLNFVQAPNGEFTVSPRNSPGEVLLNLELGPELNPYLAHLSRMYNGYAGGVEVQVLLAGNAFTAGKLVFAAVPPHFPLENISPGQITMFPHVIIDVRTLEPVLLPLPDVRNNFFHYNQQNEPRMRLVAMLYTPLRSNGSGDDVFTVSCRVLTRPSPDFDFNYLVPPTVESKTKPFTLPILTIGELTNSRFPVPIDELYTSPNESLVVQPQNGRCALDGELQGTTQLLPTAICSFRGRINQKVSGDNHVWNMQVTNINGTPFDPTEDVPAPLGTPDFSGKLFGVLSQRDHDNACRSHDAVIATDSAKFTPKLGAIQIGTWEEDDVHINQPTKFTPVGLFEREGFNQWTLPNYSGALTLNMGLAPPVAPTFPGEQILFFRSHIPLKGGVADPVIDCLLPQEWIQHLYQESAPSQTDVALIRFTNPDTGRVLFEAKLHRSGYITVANTGSRPIVVPANGYFRFDSWVNQFYSLAPMGTGNGRRRVQ

SEQ ID NO: 4037 - protein, 535 aa, Artificial Sequence
  VP1__Norovirus_and/or_Norovirus-like__AB303926
MKMASNDATPSDGSTANLVPEVNNEVMALEPVVGAAIAARVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPVPLEKLYTGPSSAFVVQPQNGRCTTDGVLLGTTQLSAVNICTFRGDVTHIAGSHDYTMNLASQNWNNYDPTEEIPAPLGTPDFVGKIQGVLTQTTREDGSTRAHKATVSTGSVHFTPKLGSVQYTTDTNNDFQTGQNTKFTPVGVIQDGSNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGR

SEQ ID NO: 4038 - protein, 535 aa, Artificial Sequence
  VP1__Norovirus_and/or_Norovirus-like__KU985166
MKMASSDANPSDGSTASLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSTFVVQPQNGRCTTDGVLLGTTQLSPVNICTFRGGITRIGQSESYKMNLASQNWNNYDPTEEIPAPLGTPDFKGRIRGLLTQTTKGAGSTRGHKATVLTGGSDFTPKLGTVRFDTKSIDFENNQNTKFTPVGVVQDGNNHDEPTQWVLPNYSGPDTHNVHLAPAVAPTFPGEQLLFFRSTMPGCSGYPKMELDCLLPQEWVQHFYQEAAPAQTDVALLRFVNPDTGRVLFECKLHKSGYVTVAHTGDHDLVIPPNGYFRFDSWVNQFYTLAPMGNGTGRRR

SEQ ID NO: 4039 - protein, 535 aa, Artificial Sequence
  VP1__Norovirus_and/or_Norovirus-like__JN699045
MMMASKDAPTSPDGASGAGQLVPEANTAEQISMDPVAGASTAVATAGQVNMIDPWIFNNFVQAPQGEFTISPNNTPGDILFDLQLGPHLNPFLAHLSQMYNGWVGNMRVRILLAGNAFTAGKIIICCVPPGFDARILTIAQATLFPHLIADVRTLEPVELPLEDVRNVLFHNSSQPQPTMRLVAMLYTPLRTGGGSGGTDAFVVAGRVLTCPAPDFSFLFLVPPSVEQKTRVFSVPNVPLKDLSNSRVPVPIQGMFMSPDVNQSVQFQNGRCQIDGQLQGTTPVSLSQLCKIRGKTSSNARVLNLSEVDGTPFIPLESPAPVGFPDLGGCDWHVNFTFQAQNQDPSQSVTFATNDASFVPYLGSISPHNGGDFHSGDIIGSLGWISAPSDSSQLNVWTIPKYGSSLPDVTHLAPAVFPPGFGEVILYFHSTFPGSGQPGQLQVPCLLPQEFITHFCNEQAPIAGEAALLHYVDPDTGRNLGEFKLYPDGFMTCVPNSVSSGPQTLPINGVFVFVSWVSRFYQLKPVGTASAARRL

SEQ ID NO: 4040 - protein, 535 aa, Artificial Sequence
  VP1__Norovirus_and/or_Norovirus-like__EF547395
MMMASKDAPTSPDGASGAGQLVPEANTAEQISMDPVAGASTAVATAGQVNMIDPWIFNNFVQAPQGEFTISPNNTPGDILFDLQLGPHLNPFLAHLSQMYNGWVGNMRVRILLAGNAFTAGKIIICCVPPGFDARILTIAQATLFPHLIADVRTLEPVELPLEDVRNVLFHNSSQPQPTMRLVAMLYTPLRTGGGSGGTDAFVVAGRVLTCPAPDFSFLFLVPPSVEQKTRVFSVPNVPLKDLSNSRVPVPIQGMFMSPDVNQSVQFQNGRCQIDGQLQGTTPVSLSQLCKIRGKTSSNARVLNLSEVDGSPFIPLESPAPVGFPDLGGCDWHVNFTFQAQDQDPSQSVTFATNDASFVPYLGSISPHNGGDFHSGDIIGSLGWISAPSDSSQLNVWTIPKYGSSLPDVTHLAPAVFPPGFGEVILYFYSTFPGSGQPGQLQVPCLLPQEFITHFCNEQAPIAGEAALLHYVDPDTGRNLGEFKLYPDGFMTCVPNSVSSGPQTLPINGVFVFVSWVSRFYQLKPVGTASVARRL

SEQ ID NO: 4041 - protein, 535 aa, Artificial Sequence
  VP1__Norovirus_and/or_Norovirus-like__AY502008
MMMASKDAPTSPDGASGAGQLVPEANTAEQISMDPVAGASTAVATAGQVNMIDPWIFNNFVQAPQGEFTISPNNTPGDILFDLQLGPHLNPFLAHLSQMYNGWVGNMRVRILLAGNAFTAGKIIICCVPPGFDARILTIAQATLFPHLIADVRTLEPVELPLEDVRNVLFHNSSQPQPTMRLVAMLYTPLRTGGGSGGTDAFVVAGRVLTCPAPDFSFLFLVPPSVEQKTRVFSVPNVPLKDLSNSRVPVPIQGMFMSPDVNQSVQFQNGRCQIDGQLQGTTPVSLSQLCKIRGKTSSNARVLNLSEVDGSPFIPLESPAPVGFPDLGGCDWHVNFTFQAQDQDPSQSVTFATNDASFVPYLGSISPHNGGDFHSGDIIGSLGWISAPSDSSQLNVWTIPKYGSSLPDVTHLAPAVFPPGFGEVILYFYSTFPGSGQPVQLQVPCLLPQEFITHFCNEQAPIAGEAALLHYVDPDTGRNLGEFKLYPDGFMTCVPNSVSSGPQTLPINGVFVFVSWVSRFYQLKPVGTASVARRL

SEQ ID NO: 4042 - protein, 535 aa, Artificial Sequence
  VP1__Norovirus_and/or_Norovirus-like__AY502007
MMMASKDAPTSPDGASGAGQLVPEANTAEQISMDPVAGASTAVATAGQVNMIDPWIFNNFVQAPQGEFTISPNNTPGDILFDLQLGPHLNPFLAHLSQMYNGWVGNMRVRILLAGNAFTAGKIIICCVPPGFDARILTIAQATLFPHLIADVRTLEPVELPLEDVRNVLYHNSSQPQPTMRLVAMLYTPLRTGGGSGGTDAFVVAGRVLTCPAPDFSFLFLVPPSVEQKTRVFSVPNIPLKDLSNSRVPVPIQGMFMSPDVNQSVQFQNGRCQIDGQLQGTTPVSLSQLCKIRGKTSSNARVLNLSEVDGTPFVPLESPAPVGFPDLGGCDWHVNFTFQAQNQDPSQSVTFATNDASFVPYLGSISPHNGGDFHAGDIIGSLGWISAPSDNTQLNVWTIPKYGSSLPDVTHLAPAVFPPGFGEVILYFYSTFPGSGQPSQLQVPCLLPQEFITHFCNEQAPIAGEAALLHYVDPDTGRNLGEFKLYPDGFMTCVPNSVSSGPQTLPINGVFVFVSWVSRFYQLKPVGTASAARRL

SEQ ID NO: 4043 - protein, 535 aa, Artificial Sequence
  VP1__Norovirus_and/or_Norovirus-like__KC998959
MMMASKDAPTSPDGASGAGQLVPEANTAEQISMDPVAGASTAVATAGQVNMIDPWIFNNFVQAPQGEFTISPNNTPGDILFDLQLGPHLNPFLAHLSQMYNGWVGNMRVRILLAGNAFTAGKIIICCVPPGFDARILTIAQATLFPHLIADVRTLEPVELPLEDVRNVLYHNSSQPQPTMRLVAMLYTPLRTGGGSGGTDAFVVAGRVLTCPAPDFSFLFLVPPSVEQKTRVFSVPNIPLKDLSNSRVPVPVQGMFMSPDVNQSVQFQNGRCQIDGQLQGTTPVSLSQLCKIRGKTSSNARVLNLSEVDGTPFIPLESPAPVGFPDLGGCDWHVNFTFQAQDQDPSQSVTFATNDASFVPYLGSISPHNGGDFHAGDIIGSLGWISAPSGNSQLNVWAIPKYGSSLPDVTHLAPAVFPPGFGEVILYFYSTFPGSGQPSQLQVPCLLPQEFITHFCNEQAPIAGEAALLHYVDPDTGRNLGEFKLYPDGFMTCVPNSVSSGPQTLPINGVFVFVSWVSRFYQLKPVGTASAARRL

SEQ ID NO: 4044 - protein, 535 aa, Artificial Sequence
  VP1__Norovirus_and/or_Norovirus-like__GQ856464
MMMASKDAPTSPDGASGAGQLVPEANTAEQISMDPVAGASTAVATAGQVNMIDPWIFNNFVQAPQGEFTISPNNTPGDILFDLQLGPHLNPFLAHLSQMYNGWVGNMRVRILLAGNAFTAGKIIICCVPPGFDARILTIAQATLFPHLIADVRTLEPVELPLEDVRNVLYHNSSQPQPTMRLVAMLYTPLRTGGGSGGTDAFVVAGRVLTCPAPDFSFLFLVPPSVEQKTRVFSVPNIPLKDLSNSRVPVPIQGMFMSPDVNQSVQFQNGRCQIDGQLQGTTPVSLSQLCKIRGKTSSNARVLNLSEVDGTPFIPLESPAPVGFPDLGGCDWHVNFTFQTQDRDPSQSVTFATNDASFVPYLGSVSPHNGEGFQAGDIIGSLGWISAPSDNSQFNVWAIPKYGSSLPDVTHLAPAVFPPGFGEVILYFYSTFPGSGQPSQLQVPCLLPQEFITHFCNEQAPIAGEAALLHYVDPDTGRNLGEFKLYPDGFMTCVPNSVSSGPQTLPINGVFVFVSWVSRFYQLKPVGTASAARRL

SEQ ID NO: 4045 - protein, 535 aa, Artificial Sequence
  VP1__Norovirus_and/or_Norovirus-like__GQ856463
MMMASKDAPTSPDGASGAGQLVPEANTAEQISMDPVAGASTAVATAGQVNMVDPWIFNNFVQAPQGEFTISPNNTPGDILFDLQLGPHLNPFLAHLSQMYNGWVGNMRVRILLAGNAFTAGKIIICCVPPGFDARILTIAQATLFPHLIADVRTLEPVELPLEDVRNVLYHNSSQPQPTMRLVAMLYTPLRTGGGSGGTDAFVVAGRVLTCPAPDFSFLFLVPPSVEQKTRVFSVPNIPLKDLSNSRVPVPIQGMFMSPDVNQSVQFQNGRCQIDGQLQGTTPVSLSQLCKIRGKTSSNARVLNLSEVDGTPFIPLESPAPVGFPDLGGCDWHVNFTFQTQDRDPSQSVTFATNDASFVPYLGSVSPHNGEGFQAGDIIGSLGWISAPSDNSQFNVWAIPKYGSSLPDVTHLAPAVFPPGFGEVILYFYSTFPGSGQPSQLQVPCLLPQEFITHFCNEQAPIAGEAALLHYVDPDTGRNLGEFKLYPDGFMTCVPNSVSSGPQTLPINGVFVFVSWVSRFYQLKPVGTASAARRL

SEQ ID NO: 4046 - protein, 535 aa, Artificial Sequence
  VP1__Norovirus_and/or_Norovirus-like__KM036372
MMMASKDAPTSPDGASGAGQLVPEANTAEQISMDPVAGASTAVATAGQVNMIDPWIFNNFVQAPQGEFTISPNNTPGDILFDLQLGPHLNPFLAHLSQMYNGWVGNMRVRILLAGNAFTAGKIIICCVPPGFDARILTIAQATLFPHLIADVRTLEPVELPLEDVRNVLYHNSSQPQPTMRLVAMLYTPLRTGGGSGGTDAFVVAGRVLTCPAPDFSFLFLVPPSVEQKTRVFSVPNIPLKDLSNSRVPVPVQGMFVSPDVNQSVQFQNGRCQIDGQLQGTTPVSLSQLCKIRGKTSSNARVLNLSEVDGTPFIPLESPAPVGFPDLGGCDWHVNFTFQTQDRDPSQSVTFATNDASFVPYLGSVSPHNGEGFQAGDIIGSLGWISAPSDNSQFNVWAIPKYGSSLPDVTHLAPAVFPPGFGEVILYFYSTFPGSGQPSQLQVPCLLPQEFITHFCNEQAPIAGEAALLHYVDPDTGRNLGEFKLYPDGFMTCVPNSVSSGPQTLPINGVFVFVSWVSRFYQLKPVGTASAARRL

SEQ ID NO: 4047 - protein, 535 aa, Artificial Sequence
  VP1__Norovirus_and/or_Norovirus-like__AF538678
MKMASKDAPPSPDGASGAGQLVPEVNTADQISMDPVAGASTAVATAGQVNMIDPWIFNNFVQAPQGEFTISPNNTPGDILFDLQLGPHLNPFLAHLSQMYNGWVGNMRVRILLAGNAFTAGKIIICCVPPGFDARILTIAQATLFPHLIADVRTLEPVELPLEDVRNVLYHNSSQPQPTMRLVAMLYTPLRTGGGSGGTDAFVVAGRVLTCPAPDFSFLFLVPPSVEQKTRVFSVPNIPLKDLSNSRVPTLIQGMFVSPDVNQSVQFQNGRCQIDGQLQGTTPVSLSQLCKIRGKTSSNTRVLNLSEVDGTPFVPLESPAPVGFPDIGGCDWHVGFTFEARDQDPSQNVTFATNDSSFVPYLGSISPHNGDGFHSGDIVGSLDWISAPSDGSALDVWSIPKYGSSLPDVTHLAPVVFPPGFGEVILYFHSKFPGSGPTDKLRVPCLMPQEFITHFCNEQAPIAGEAALLHYVDPDTGRNLGEFKLYSDGFMTCVPNSISSGPQTLPINGVFVFVSWVSRFYQLKPVGTASAARRL

SEQ ID NO: 4048 - protein, 535 aa, Artificial Sequence
  VP1__Norovirus_and/or_Norovirus-like__KC294198
MMMASKDAPTSPDGASGAGQLVPEANTAEQISMDPVAGASTAVATAGQVNMIDPWIFNNFVQAPQGEFTISPNNTPGDILFDLQLGPHLNPFLAHLSQMYNGWVGNMRVRILLAGNAFTAGKIIICCVPPGFDARILTIAQATLFPHLIADVRTLEPVELPLEDVRNVLFHNSSQPQPTMRLVAMLYTPLRTGGGSGGTDAFVVAGRVLTCPAPDFSFLFLVPPSVEQKTRVFSVPNIPLKDLSNSRVPVPVQGMFMSPDVNQSVQFQNGRCQIDGQLQGTTPVSLSQLCKIRGKTSSNARVLNLSEVDGTPFIPLESPAPVGFPDLGGCDWHVNFTFQAQNQDPSQSVTFATNDASFVPYLGSISPHNGGDFHAGDIIGSLGWISAPSDNSQLNVWTIPKYGSSLPDVTHLAPAVFPPGFGEVILYFYSTFPGSGQSSQLQVPCLLPQEFITHFCNEQAPIAGEAALLHYVDPDTGRNLGEFKLYPDGFMTCVPNSVSSGPQTLPINGVFVFVSWVSRFYQLKPVGTASAARRL

SEQ ID NO: 4049 - protein, 535 aa, Artificial Sequence
  VP1__Norovirus_and/or_Norovirus-like__KT732280
MMMASKDAPTSPDGASGAGQLVPEVNTADQISMDPVAGASTAVATAGQVNMIDPWIFNNFVQAPQGEFTISPNNTPGDILFDLQLGPHLNPFLAHLSQMYNGWVGNMRVRILLAGNAFTAGKIIICCVPPGFDARILTIAQATLFPHMIADVRTLEPVELPLEDVRNVLYHNSSQPQPTMRLVAMLYTPLRTGGGSGGTDAFVVAGRVLTCPAPDFSFLFLVPPSVEQKTRVFSVPNIPLKDLSNSRVPTLIQGMFVSPDVNQSVQFQNGRCQIDGQLQGTTPVSLSQLCKIRGKTSSNARVLNLSEVDGTPFVPLESPAPVGFPDLGGCDWHVGFTFEARDQDPSQNVTFATNDSSFVPYLGSISPHNGDGFHSGDIIGSLDWISAPSDGSTLDVWSIPKYGSSLPDVTHLAPAVFPPGFGEVILYFHSKFPGSGPTDKLRVPCLIPQEFITHFCNEQAPIAGEAALLHYVDPDTGRNLGEFKLYPDGFMTCVPNSISSGPQTLPTNGVFVFVSWVSRFYQLKPVGTASMARRL

SEQ ID NO: 4050 - protein, 535 aa, Artificial Sequence
  VP1__Norovirus_and/or_Norovirus-like__LC101822
MMMASKDVPTSPDGASGAGQLVPEVNTADQISMDPVAGASTAVATAGQVNMIDPWIFNNFVQAPQGEFTISPNNTPGDILFDLQLGPHLNPFLAHLSQMYNGWVGNMRVRILLAGNAFTAGKIIICCVPPGFDARILTIAQATLFPHLIADVRTLEPVELPLEDVRNVLYHNSSQPQPTMRLVAMLYTPLRTGGGSGGTDAFVVAGRVLTCPAPDFSFLFLVPPSVEQKTRVFSVPNIPLKDLSNSRVPTLIQGMFVSPDVNQSVQFQNGRCQIDGQLQGTTPVSLSQLCKIRGKTSSNTRVLNLSEVDGTPFVPLESPAPVGFPDIGGCDWHVGFTFEARDQGPSQNVTFATNDSSFVPYLGSISPHNGDGFHSGDIIGSLDWISAPSDGSALDVWSIPKYGSSLPDVTHLAPAVFPPGFGEVILYFHSKFPGSGPTDKLRVPCLMPQEFITHFCDEQAPIAGEAALLHYVDPDAGRNLGEFKLYPDGFMTCVPNSISSGPQTLPINGVFVFVSWVSRFYQLKPVGTASMARRL

SEQ ID NO: 4051 - protein, 535 aa, Artificial Sequence
  VP1__Norovirus_and/or_Norovirus-like__KP407451
MMMASKDAPTSPDGASGAGQLVPEANTAEQISMDPVAGASTAVATAGQVNMIDPWIFNNFVQAPQGEFTISPNNTPGDILFDLQLGPHLNPFLAHLSQMYNGWVGNMRVRILLAGNAFTAGKIIICCVPPGFDARILTIAQATLFPHLIADVRTLEPVELPLEDVRNVLYHNSSQPQPTMRLVAMLYTPLRTGGGSGGTDAFVVAGRVLTCPAPDFSFLFLVPPSVEQKTRVFSVPNIPLKDLSNSRVPVPIQGMFMSPDVNQSVQFQNGRCQIDGQLQGTTPVSLSQLCKIRGKTSSNARVLNLSEVDGTPFIPLESPAPVGFPDLGGCDWHVNFSFQTQDRDPSQSVTFATNDASFVPYLGSVSPHNGEGFQAGDIIGSLGWISAPSDNSQFNVWAIPKYGSSLPDVTHLAPAVFPPGFGEVILYFYSTFPGSGQPSQLQVPCLLPQEFITHFCNEQAPIAGEAALLHYVDPDTGRNLGEFKLYPDGFMTCVPNSVSSGPQTLPINGVFVFVSWVSRFYQLKPVGTASAARRL

SEQ ID NO: 4052 - protein, 535 aa, Artificial Sequence
  VP1__Norovirus_and/or_Norovirus-like__LN854564
MMMASKDAPTSPDGASGAGQLVPEANTAEQISMDPVAGASTAVATAGQVNMIDPWIFNNFVQAPQGEFTISPNNTPGDILFDLQLGPHLNPFLAHLSQMYNGWVGNMRVRILLAGNAFTAGKIIICCVPPGFDARILTIAQATLFPHLIADVRTLEPVELPLEDVRNVLYHNSSQPQPTMRLVAMLYTPLRTGGGSGGTDAFVVAGRVLTCPAPDFSFLFLVPPSVEQKTRVFSVPNIPLKDLSNSRVPVPIQGMFMSPDVNQSVQFQNGRCQIDGQLQGTTPVSLSQLCKIRGKTSSNARVLNLSEVDGTPFIPLESPAPVGFPDLGGCDWHVNFTFQAQNQDPSQSVTFATNDASFVPYLGSISPHNGGDFHAGDIIGSLGWISAPSDNSQLNVWTIPKYGSSLPDVTHLAPAVFPPGFGEVILYFYSTFPGSGQPSQLQVPCLLPQEFITHFCNEQAPIAGEAALLHYVDPDTGRNLGEFKLYPDGFMTCVPNSVSSGPQTLPINGVFVFVSWVSRFYQLKPVGTASAARRL

SEQ ID NO: 4053 - protein, 535 aa, Artificial Sequence
  VP1__Norovirus_and/or_Norovirus-like__JQ388274
MMMASKDAPTSPDGASGAGQLVPEANTAEQISMDPVAGASTAVATAGQVNMIDPWIFNNFVQAPQGEFTISPNNTPGDILFDLQLGPHLNPFLAHLSQMYNGWVGNMRVRILLAGNAFTAGKIIICCVPPGFDARILTIAQATLFPHLIADVRTLEPVELPLEDVRNVLYHNSSQPQPTMRLVAMLYTPLRTGGGSGGTDAFVVAGRVLTCPAPDFSFLFLVPPSVEQKTRVFSVPNIPLKDLSNSRVPVPVQGMFMSPDVNQSVQFQNGRCQIDGQLQGTTPVSLSQLCKIRGKTSSNARVLNLSEVDGTPFIPLESPAPVGFPDLGGCDWHVNFTFQAQNQDPSQSVTFATNDASFVPYLGSISPHNGGDFHAGDIIGSLGWISAPSDNSQLNVWTIPKYGSSLPDVTHLAPAVFPPGFGEVILYFYSTFPGSGQPSQLQVPCLLPQEFITHFCNEQAPIAGEAALLHYVDPDTGRNLGEFKLYPDGFMTCVPNSVSSGPQTLPINGVFVFVSWVSRFYQLKPVGTASAARRL

SEQ ID NO: 4054 - protein, 535 aa, Artificial Sequence
  VP1__Norovirus_and/or_Norovirus-like__KP027330
MMMASKDAPTSPDGASGAGQLVPEVNTADQISMDPVAGASTAVATAGQVNMIDPWIFNNFVQAPQGEFTISPNNTPGDILFDLQLGPHLNPFLAHLSQMYNGWVGNMRVRILLAGNAFTAGKIIICCVPPGFDARILTIAQATLFPHMIADVRTLEPVELPLEDVRNVLYHNSSQPQPTMRLVAMLYTPLRTGGGSGGTDAFVVAGRVLTCPAPDFSFLFLVPPSVEQKTRVFSVPNIPLKDLSNSRVPTLIQGMFVSPDVNQSVQFQNGRCQIDGQLQGTTPVSLSQLCKIRGKTSSNARVLNLSEVDGTPFVPLESPAPVGFPDLGGCDWHVGFTFEARDQDPSQNVTFATNDSSFVPYLGSISPHNGDGFHSGDIIGSLDWISAPSDGSTLDVWSIPKYGSSLPDVTHLAPAVFPPGFGEVILYFHSKFPGSGPTDKLRVPCLIPQEFITHFCNEQAPIAGEAALLHYVDPDTGRNLGEFKLYPDGYMTCVPNSISSGPQTLPTNGVFVFVSWVSRFYQLKPVGTASMARRL

SEQ ID NO: 4055 - protein, 535 aa, Artificial Sequence
  VP1__Norovirus_and/or_Norovirus-like__AF093797
MMMASKDAPPSPDGASGAGQLVPEVNTADQISMDPVAGASTAVATAGQVNMIDPWIFNNFVQAPQGEFTISPNNTPGDILFDLQLGPHLNPFLAHLSQMYNGWVGNMRVRILLAGNAFTAGKVIICCVPPGFDARILTIAQATLFPHLIADVRTLEPVELPLEDVRNVLYHNSSQPQPTMRLVAMLYTPLRTGGGSGGTDAFVVAGRVLTCPAPDFSFLFLVPPSVEQKTRVFSVPNIPLKDLSNSRVPTLIQGMFVSPDVNQSVQFQNGRCQIDGQLQGTTPVSLSQLCKIRGRTSSNTRVLNLSEVDGTPFVPLESPAPVGFPDIGGCDWHVGFTFEARDQDPSQNVTFATNDSSFVPYLGSISPHNGDGFHSGDIIGSLDWISAPSDGSALDVWSIPKYGSSLPDVTHLAPAVFPPGFGEVILYFHSKFPGSGPTDKLRVPCLIPQEFITHFCNEQAPIAGEAALLHYVDPDTGRNLGEFKLYPDGFMTCVPNSISSGPQTLPINGVFVFVSWVSRFYQLKPVGTASAARRL

SEQ ID NO: 4056 - protein, 535 aa, Artificial Sequence
  VP1__Norovirus_and/or_Norovirus-like__AB810006
MKMASNDAAPSNDGAASLVPEAINETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFIYLVPPSVESKTKPFTLPILTISELTNSRFPIPIEQLYTAPNENNVVQCQNGRCTLDGELQGTTQLLSSAVCSYRGRTVANRGDNWDQNLLQLTYPSGASYDPTDEVPAPLGTQDFSGILYGVLTQDNVSEGTGEAKNAKGVYISTTSGKFTPKIGSIGLHSITENVHPNQQSRFTPVGVAQNENTPFQQWVLPHYAGALALNTNLAPAVAPTFPGEQLLFFRSRVPCVQGLRGQDAFIDCLLPQEWVNHFYQEAAPSQADVALIRYVNPDTGRTLFEAKLHRSGFITVSHTGAYPLVVPPNGPFRFDSWVNQFYSLAPMGTG

SEQ ID NO: 4057 - protein, 534 aa, Artificial Sequence
  VP1__Norovirus_and/or_Norovirus-like__LC101825
MMMASKDATPSADGANGAGQLVPEVNNAEPLPLDPVAGASTALATAGQVNMIDPWIFNNFVQAPQGEFTISPNNTPGDILFDLQLGPHLNPFLAHLSQMYNGWVGNMRVRVILAGNAFTAGKVIICCVPPGFQSRTLSIAQATLFPHVIADVRTLEPLEIPLEDVRNTLYHNNDSQPTMRLLCMLYTPLRTGGGSGGTDAFVVAGRVLTCPSPDFNFLFLVPPTVEQKTRPFSVPNIPLQNLSNSRVPSLIQSMVLSSDHAQTVQFQNGRCTTDGHLLGTTPVSSGQLMKFRGKVTPGSKVLNLTELDGSPFLAFEPPAPAGFPDLGKCDWHIEMSLYQVNNQDNPIVLRAIEPNSSSFVPHLGSVSFNQNVDAAGDYVCTIQYTSPPSNSHDADVDFWSIPDYGSNLAEASQLAPVVYPPGFGEAIVYFMSRVPGWNRTNRLNLVPCLLPQEFIGHFVSEQAPAIGEAALLHYVDPDTNRNLGEFKLYPEGFITCVPNGTGPQQLPLNGVFVFSSWVSRFYQLKPVGTASSAR

SEQ ID NO: 4058 - protein, 534 aa, Artificial Sequence
  VP1__Norovirus_and/or_Norovirus-like__AB081723
MMMASKDAPTSPDGASGAGQLVPEANTAEQISMDPVAGASTAVATAGQVNMIDPWIFNNFVQAPQGEFTISPNNTPGDILFDLQLGPHLNPFLAHLSQMYNGWVGNMRVRILLAGNAFTAGKIIICCVPPGFDARILTIAQATLFPHLIADVRTLEPVELPLEDVRNVLYHNSSQPQPTMRLVAMLYTPLRTGGGSGGTDAFVVAGRVLTCPAPDFSFLFLVPPSVEQKTRVFSVPNIPLKDLSNSRVPVPIQGMFMSPDVNQSVQFQNGRCQIDGQLQGTTPVSLSQLCKIRGKTSSNARVLNLSEVDGTPFIPLESPAPVGFPDLGGCDWHVNFTFQAQNQDPSQSVTFATNDASFVPYLGSISPHNGGDFHAGDIIGSLGWISAPSDNTQLNVWTIPKYGSSLQMSLTLHLLCSPRLWEVILYFYSTFPGSGQPSQLQVPCLLPQEFITHFCNEQAPIAGEAALLHYVDPDTGRNLGEFKLYPDGFMTCVPNSVSSGPQTLPINGVFVFVSWVSRFYQLKPVGTASAARRL

SEQ ID NO: 4059 - protein, 534 aa, Artificial Sequence
  VP1__Norovirus_and/or_Norovirus-like__JN005886
MMMASKDAPSNMDGTSGAGQLVPEVNAAEPLPLEPVVGAATAAATAGQVNLIDPWIMNNFVQAPEGEFTISPNNTPGDILFDLHLGPHLNPFLQHLSQMYNGWVGNMRVRVMLAGNAFTAGKIIICCVPPGFASQNISIGQATMFPHVIADVRVLEPIEIPLDDVRNVLFHTNENRPTMRLLCMLYTPLRAGGASSGTDPFVIAGRVLTCPSPDFNFLFLVPPSVEQKTRQLTVPNIPLNNLANSRVPAMINKMTVSTDQNQVVQFQNGRCTLEGQLLGTTPVSASQVARIRGKVFSTASGKGLNLTELDGTPYHAFESPAPLGFPDIGACDWHVSTFKVDQNLSGDPMSRLDVKQNAPFAPHLGSIEFTSDQDPTGDQLGTLAWVSPSTSGARVDPWKIPSYGSTVTESTHLAPPIFPPGFGEAIVYFMSDFPIVSGNTAQVPCTLPQEFVSHFVEQQAPVRGEAALLHYVDPDTHRNLGEFKLYPDGFITCVPNTGGGPQNLPTNGVFVFSSWVSRYYQLKPVGTAGPARRL

SEQ ID NO: 4060 - protein, 534 aa, Artificial Sequence
  VP1__Norovirus_and/or_Norovirus-like__AB758449
MMMASKDAPSNMDGTSGAGQLVPEVNAAEPLPLEPVVGAATAAATAGQVNLIDPWIMNNFVQAPEGEFTISPNNTPGDILFDLQLGPHLNPFLQHLSQMYNGWVGNMRVRVMLAGNAFTAGKIIICCVPPGFASQNISIGQATMFPHVIADVRVLEPIEIPLDDVRNVLFHTNENRPTMRLLCMLYTPLRAGGASSGTDPFVIAGRVLTCPSPDFNFLFLVPPSVEQKTRQLTVPNIPLNNLANSRVPAMINKMTVSTDQNQVVQFQNGRCTLEGQLLGTTPVSASQVARIRGKVFSTASGKGLNLTELDGTPYHAFESPAPLGFPDIGACDWHVSTFKVDQNLSGDPMSRLDIKQNAPFAPHLGSIEFTSDQEPTGDQLGTLAWVSPSTSGARVDPWKIPSYGSTVTESTHLAPPIFPPGFGEAIVYFMSDFPIVSGNTAQVPCTLPQEFVSHFVEQQAPIRGEAALLHYVDPDTHRNLGEFKLYPDGFITCVPNTGGGPQNLPINGVFVFSSWVSRYYQLKPVGTAGPARRL

SEQ ID NO: 4061 - protein, 534 aa, Artificial Sequence
  VP1__Norovirus_and/or_Norovirus-like__KX907729
MMMASKDAPSNMDGTSGAGQLVPEVNAAEPLPLEPVVGAATAVATAGQVNLIDPWIMNNFVQAPEGEFTISPNNTPGDILFDLQLGPHLNPFLQHLSQMYNGWVGNMRVRVMLAGNAFTAGKIIICCVPPGFASQNISIGQATMFPHVIADVRVLEPIEIPLDDVRNVLFHTNESRPTMRLLCMLYTPLRAGGASSGTDPFVIAGRVLTCPSPDFNFLFLVPPSVEQKTRQLTVPNIPLNNLANSRVPAMINKMTVSTDQSQVVQFQNGRCTLEGQLLGTTPVSASQVARIRGKVFSTASGKGLNLTELDGTPYHAFESPAPLGFPDIGACDWHVSTFKVDQNLSGDPMSRLDIKQNAPFAPHLGSIEFTSDQEPTGDQLGTLAWVSPSTSGARVDPWKIPSYGSTVTESTHLAPPIFPPGFGEAIVYFMSDFPIVSGNTAQVPCTLPQEFVSHFVEQQAPIRGEAALLHYVDPDTHRNLGEFKLYPDGFITCVPNTGGGPQNLPINGVFVFSSWVSRYYQLKPVGTAGPARRL

SEQ ID NO: 4062 - protein, 533 aa, Artificial Sequence
  VP1__Norovirus_and/or_Norovirus-like__JN899243
MMMASKDAPSNMDGTSGAGQLVPEVNTAEPLPLEPVVGAATAAATAGQVNLIDPWIMNNFVQAPEGEFTISPNNTPGDILFDLRLGPHLNPFLLHLSQMYNGWVGNMRIRVMLAGNAFSAGKIIICCVPPGFESQNISIGQATMFPHVIADVRVLEPIEIPLDDVRNVLYHTNENRPTMRLLCMLYTPLRAGGASSGTDPFVIAGRVLTCPAPDFNFLFLVPPSVEQKTRQLTIPNIPLNNLANSRVPAMINKMAVSADQNQVVQFQNGRCTLEGQLLGTTPVSANQVARIRGKVFSTNSGTGLNLTETDGTPYHAFESPAPLGFPDIGDCDWHVYAFKVNQNTGDPMYRLDITQGNSFAPHLGSIEFTSDQHPSGDQLGTLTWISPLNNASRVDPWKIPSYGSTLTESTNLAPPIFPPGFGEAIVYFMSDFPIVSGNTTQIPCTLPQEFISSFVEQQAPIRGEAALLHYVDPDTHRNLGEFKLYPDGFITCVPNTGGGPQNLPSNGVFIFSSWVSRYYQLKPVGTAGPARRL

SEQ ID NO: 4063 - protein, 533 aa, Artificial Sequence
  VP1__Norovirus_and/or_Norovirus-like__AB810004
MKMASNDAAPSNDGAASLVPEAINETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFIYLVPPSVESKTKPFTLPILTISELTNSRFPIPIEQLYTAPNENNVVQCQNGRCTLDGELQGTTQLLSSAVCSYRGRTVANRGDNWDQNLLQLTYPSGASYDPTDEVPAPLGTQDFSGILYGVLTQDNVSEGTGEAKNAKGVYISTTSGKFTPKIGSIGLHSITENVHPNQQSRFTPVGVAQNENTPFQQWVLPHYAGALALNTNLAPAVAPTFPGEQLLFFRSRVPCVQGLRGQDAFIDCLLPQEWVNHFYQEAAPSQADVALIRYVNPDTGRTLFEAKLHRSGFITVSHTGAYPLVVPPNGHFRFDSWVNQFYSLAPMG

SEQ ID NO: 4064 - protein, 533 aa, Artificial Sequence
  VP1__Norovirus_and/or_Norovirus-like__JN183163
MMMASKDATPSADGATGAGQLVPEVNTADPIPIDPVAGSSTALATAGQVNLIDPWIINNFVQAPQGEFTISPNNTPGDVLFDLQLGPHLNPFLSHLSQMYNGWVGNMRVRVVLAGNAFTAGKVIICCVPPGFQSRTLSIAQATLFPHVIADVRTLDPVEVPLEDVRNVLYHNNDTQPTMRLLCMLYTPLRTGGASGGTDSFVVAGRVLTCPGPDFNFLFLVPPTVEQKTRPFTVPNIPLKYLSNSRIPNPIEGMSLSPDQTQNVQFQNGRCTIDGQPLGTTPVSVSQLCKFRGRITSGQRVLNLTELDGSPFMAFAAPAPAGFPDLGSCDWHIEMSKIPNSSTQNNPIVVNSVKPNSQQFVPHLSSITLDDNVSSGGDYIGTIQWTSPPSDSGGANTNFWKIPDYGSSLAEASQLAPAVYPPGFNEVIVYFMASIPGPNQSGSPNLVPCLLPQEYITHFISEQAPIQGEAALLHYVDPDTNRNLGEFKLYPGGYLTCVPNSSSTGPQQLPLDGVFVFASWVSRFYQLKPVGTA

SEQ ID NO: 4065 - protein, 532 aa, Artificial Sequence
  VP1__Norovirus_and/or_Norovirus-like__EU373815
MKMASNDASPSSDGSANLVPEINNEVMALEPVAGAAIAAPVAGQQNIIDPWIRNNFVQAPGGEFTVSPRNAPGEVLLNLPLSPDINPYLAHLSRMYNGYAGGVEVEVVLAGNAFTAGKIIFAAVPPNFPPENLSPSQITMLPHIIVDVRQLEPVRIPLPDVRNNFYHYSRENDSTLRLVAMLYTPLRANNAGDDVFTVSCRVLTRPSPDFDFIFLVPPTVESKSKPFTIPILTIEEMTNSRFPAPLEMMTTGPSHDIVVQPQNGRCTIDGVLLGTTQLSPVNICSMRGVPTKRTNGTDNCFVQLENPNGSAYDPTEDIPAVLGSPDFVGEFYGTITQRSPNNSTRAHPFTLNTGSPRYTPKIGSVDIHVTDVDDLNDHEPVKLTPVGLSGSSGSIHQWQLPNYSGVATHNMHLAPSVAPLFPGEQILFFRSTVPGCGGYPNTNIDCLIPQEWVQHFYQEGAPARTDVALLRFINPDTGRVLFECKLHKHGFITVAYSGNHDLVMPPNGYFRFESWVNQFHTLAPMGTGRAEE

SEQ ID NO: 4066 - protein, 532 aa, Artificial Sequence
  VP1__Norovirus_and/or_Norovirus-like__KC473547
MASKDAPTSPDGASGAGQLVPEANTAEQISMDPVAGASTAVATAGQVNMIDPWIFNNFVQAPQGEFTISPNNTPGDILFDLQLGPHLNPFLAHLSQMYNGWVGNMRVRILLAGNAFTAGKIIICCVPPGFDARILTIAQATLFPHLIADVRTLEPVELPLEDVRNVLYHNSSQPQPTMRLVAMLYTPLRTGGGSGGTDAFVVAGRVLTCPAPDFSFLFLVPPSVEQKTRVFSVPNIPLKDLSNSRVPVPIQGMFMSPDVNQSVQFQNGRCQIDGQLQGTTPVSLSQLCKIRGKTSSNARVLNLSEVDGTPFIPLESPAPVGFPDLGGCDWHVNFSFQTQDRDPSQSVTFATNDASFVPYLGSVSPHNGEGFQAGDIIGSLGWISAPSDNSQFNVWAIPKYGSSLQMSPILLLLCSPRLWEVILYFYSTFPGSGQPSQLQVPCLLPQEFITHFCNEQAPIAGEAALLHYVDPDTGRNLGEFKLYPDGFMTCVPNSVSSGPQTLPINGVFVFVSWVSRFYQLKPVGTASAARRL

SEQ ID NO: 4067 - protein, 532 aa, Artificial Sequence
  VP1__Norovirus_and/or_Norovirus-like__GQ266692
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQEYTMNLASQNWNNYDPTEEIPAPLGTPDFVGKIQGVLTQTTRRDGSTRGHKATVSTGSVQFTPKLGRIQFSTDTSNDFETGQNTRFTPVGVVQDGSTTHQNEPQQWVLPNYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLASMAT

SEQ ID NO: 4068 - protein, 532 aa, Artificial Sequence
  VP1__Norovirus_and/or_Norovirus-like__GQ266693
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSTFVVQPQNGRCTTDGVLLGTTQLSPVNICTFRGDVTHIASTRVYTMNLASQNWNNYDPTEEIPAPLGTPDFVGKIQGVLTQTTRGDGSTRGHKATVSTGSVEFTPKLGRIQFSTDTSNDFETGQNTRFTPVGVIQDGNTTHQNEPQQWALPNYSGSGSHNVHLAPAVAPSFPGEQLLFFRSTMPGCSGYPNMNLECLLPQEWVQHFYQEAAPAQSDVALLRFVNPDTGRVLFECKLHKSGYVTVAHTGQHDLVIPPNGYFRFDSWINQFYTLASMAT

SEQ ID NO: 4069 - protein, 532 aa, Artificial Sequence
  VP1__Norovirus_and/or_Norovirus-like__EU004673
MRMSDGAAPKASGSEASGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVLQPRLCTHARWPAPVYGLLVDPSLPSNPQWQNGRVHIDGTLLGTTPVSGSWVSCFAAEAAYEFQSGTGEVATFTLIEQDGSAYVPGDRAAPLGYPDFSGQLEIEVQTETTRAGDKLKVTTFEMILGPTTNVDQAPYQGRVYASLTAAASLDLVDGRVRAVPRSIYSFQDVLPEYNDGLLVPLAPPIGPFLPGEVLLRFRTYMRQVDSSDAAAEAIDCALPQEFVSWFASNGFTVQSEALLLRYRNTLTGQLLFECKLYSEGYIALSYSGSGPLTFPTDGFFEVVSWVPRLFQLASVGS

SEQ ID NO: 4070 - protein, 532 aa, Artificial Sequence
  VP1__Norovirus_and/or_Norovirus-like__AB601769
MRMSDGAAPKANGSEASGQDLVLTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVLQPRLCTHARWPAPVYGLLVDPSLPSNPQWQNGRVHVDGTLLGTTPVSGSWVSCFAAEAAYEFQSGTGEVATFTLIEQDGSAYVPGERAAPLGYPDFSGQLEIEVQTETTKRGEKLKVTTFEMILGPTTNVDQAPYQGRVYASLSAAASLDLVDGRVRAVPRSIYGFQDVIPEYNDGLLVPLAPPIGPFLPGEVLLRFRTYMRQVDSSDAAAEAIDCALPQEFVSWFASNGFTVQSEALLLRYRNTLTGQLLFECKLYSEGYIALSYSGSGPLTFPTDGFFEVVSWVPRLYQLASVGS

SEQ ID NO: 4071 - protein, 532 aa, Artificial Sequence
  VP1__Norovirus_and/or_Norovirus-like__EU004676
MRMSDGAAPKANGSEASGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAPDFNFVYLTPPIERTIYRMVDLPVLQPRLCTHARWPAPVYGLLVDPSLPSNPQWQNGRVQVDGTLLGTTPVSGSWVSCFAAEAAYEFQAGTGEVVTFTMIEQDGSAYVPGDRAAPLGYPDFSGQLEIEVQTETTKTGDKLRVTTFEMILGPTTNVDQAPYQGRAYASLTAAASLDLVDGRVRAVPRSIYSFQDELPEYNDGLLVPLAPPLGPFLPGEVLLRFRTYMRQLDTADAAAQPIDCALPQEFISWFASNNFTVQSDALLVRYRNTLTGQLLFEAKLYSEGYIAVSYSGSGPLTFPTDGFFEVVSWVPRLFQLASVGS

SEQ ID NO: 4072 - protein, 532 aa, Artificial Sequence
  VP1__Norovirus_and/or_Norovirus-like__JQ237823
MRMSDGAAPKANGSEASGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAPDFNFVYLTPPIERTIYRMVDLPVLQPRLCTHARWPAPVYGLLVDPSLPSNPQWQNGRVQVDGTLLGTTPVSGSWVSCFAAEAAYEFQAGTGEVVTFTMIEQDGSAYVPGDRAAPLGYPDFSGQLEIEVQTETTKTGDKLRVTTFEMILGPTTNVDQAPYQGRAYASLTAAASLDLVDGRVRAVPRSIYSFQDELPEYNDGVLVPLAPPLGPFLPGEVLLRFRTYMRQLDTADAAAQPIDCALPQEFISWFASNNFTVQSDALLVRYRNTLTGQLLFEAKLYSEGYIAVSYSGSGPLTFPTDGFFEVVSWVPRLFQLASVGS

SEQ ID NO: 4073 - protein, 532 aa, Artificial Sequence
  VP1__Norovirus_and/or_Norovirus-like__DQ223043
MRMSDGAAPKANGSEASGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPASDFNFVYLTPPIERTIYRMVDLPVLQPRLCTHARWPAPVYGLLVDPSLPSNPQWQNGRVHVDGTLLGTTPVSGSWVSCFAAEAAYEFQSGTGEVATFTMIEQDGSAYVPGDRAAPLGYPDFSGQLEIEVQTETTKTGDKLKVTTFEMILGPTTNVDQAPYQGRAYASLTAAASLDLVDGRVRAVPRSVYSFQDELPEYNDGLLVPLAPPLGPFLPGEVLLRFRTYMRQLDTADASAQPIDCALPQEFISWFASNNFTVQSDALLVRYRNTLTGQLLFEAKLYSEGYIAVSYSGSGPLTFPTDGFFEVVSWVPRLFQLASVGS

SEQ ID NO: 4074 - protein, 532 aa, Artificial Sequence
  VP1__Norovirus_and/or_Norovirus-like__JX048594
MRMSDGAAPKANGSEASGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRALEPIQLPLLDVRRVLWHATQDQEESMRLVCMLYTPLRTNSPGDESFVVSGRLLSKPAADFNFVYLTPPIERTIYRMVDLPVLQPRLCTHARWPAPVYGLLVDPSLPSNPQWQNGRVHVDGTLLGTTPVSGSWVSCFAAEAAYEYQSEVGEVATFTLIEQDGSAYVPGDRAAPLGYPDYSGQLEIEVQTETTKTGDKLKVTTFDMILGPTTNVDQVPYQGKVYASLTTASSLDLVDGRARAVPRSVYSFQDVLPEYNDGLLVPLAPPLGPYLPGEVLLRFRTYMRQLDTADAAAQPIDCALPQEFISWFASNNFTVQSDALLIRYRNTLTGQLLFEAKLYSEGYIAVSYSGSGPLTFPTDGFFEVVSWVPRLFQLASVGS

SEQ ID NO: 4075 - protein, 531 aa, Artificial Sequence
  VP1__Norovirus_and/or_Norovirus-like__GQ266691
MKMASSDANPSDGSTASLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTIEEMTNSRFPIPLEKLFTGPSSAFVVQPQNGRCTIDGVLLGTTQLSPVNICTFRGDVTHIEGSKVYTMNLASQNWNNYDPTEEIPAPLGTPDFKGRIQGVLTQTTRSDGSTRGHTATVSTGSAEFTPKLGRIQFSTDTNNDFETGQNTKFTPVGVVQNGSTTHQNEPQQWELPDYSGRGIHNVHLAPAVAPTYPGEQILFFRSTMPGCSGYPNMNLDCLLPQDWVRHFYQEAAPAQSDVALLRFVNPDTGRVLFECKLHKSGYVTVAHTGQHDLVIPPNGYFRFDSWVNQFYTLAPMG

SEQ ID NO: 4076 - protein, 531 aa, Artificial Sequence
  VP1__Norovirus_and/or_Norovirus-like__GQ266690
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQEYTMNLASQNWNNYDPTEEIPAPLGTPDFVGRIQGVLTQTTRRDGSTRGHKATVSTGSVHFTPKLGRIQFSTDTSNDFETGQNTRFTPVGVVQDGGTTHQNEPQQWVLPNYSGRDGHNVHLAPAVAPSFPGEQILFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMG

SEQ ID NO: 4077 - protein, 531 aa, Artificial Sequence
  VP1__Norovirus_and/or_Norovirus-like__JN183164
MMMASKDAPTNMDGTSGAGQLVPEVSTAEPISMEPVAGAATAAATAGQVNMIDPWIMSNYVQAPQGEFTISPNNTPGDILFDLQLGPHLNPFLSHLAQMYNGWVGNMKVRVLLAGNAFTAGKIIISCVPPGFAAQNVSIAQATMFPHVIADVRVLEPIEVPLEDVRNVLFHNNDSTPTMRLICMLYTPLRASGSSSGTDPFVIAGRVLTCPSPDFNFLFLVPPNVEQKTKPFSVPNLPLNVLSNSRVPSLIKSMMVSQDHGQMVQFQNGRVTLDGQLQGTTPTSASQLCKIRGTVYHATGGQGLNLTEIDGTPYHAFESPAPIGFPDLGECDWHINASPANAFTDGSIIHRIDVAQDSTFAPHLGTIHYTNADYNANVGLICSLEWLSPPSGGAPKVNPWAIPRYGSTLTEAAQLAPPIYPPGFGEAIVFFMSDFPIANGSDGLSVPCTIPQEFVTHFVNEQAPTRGEAALLHYVDPDTHRNLGEFKLYPEGFMTCVPNSSGSGPQTLPINGVFTFISWVSRFYQLKPVGT

SEQ ID NO: 4078 - protein, 531 aa, Artificial Sequence
  VP1__Norovirus_and/or_Norovirus-like__AB809995
MKMASNDAAPSNDGAASLVPEAINETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFIYLVPPSVESKTKPFTLPILTISELTNSRFPIPIEQLYTAPNENNVVQCQNGRCTLDGELQGTTQLLSSAVCSYRGRTVANSGDNWDQNLLQLTYPSGASYDPTDEVPAPLGTQDFSGILYGVLTQDNVSEGTGEAKNAKGVYISTTSGKFTPKIGSIGLHSITENVHPNQQSRFTPVGVAQNENTPFQQWVLPHYAGALALNTNLAPAVAPTFPGEQLLFFRSRVPCVQGLRGQDAFIDCLLPQEWVNHFYQEAAPSQADVALIRYVNPDTGRTLFEAKLHRSGFITVSHTGAYPLVVPPNGHFRFDSWVNQFYSLAP

SEQ ID NO: 4079 - protein, 530 aa, Artificial Sequence
  VP1__Norovirus_and/or_Norovirus-like__KT732275
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPM

SEQ ID NO: 4080 - protein, 530 aa, Artificial Sequence
  VP1__Norovirus_and/or_Norovirus-like__AB809998
MKMASNDAAPSNDGAASLVPEAINETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFIYLVPPSVESKTKPFTLPILTISELTNSRFPIPIEQLYTAPNENNVVQCQNGRCTLDGELQGTTQLLSSAVCSYRGRTVANSGDNWDQNLLQLTYPSGASYDPTDEVPAPLGTQDFSGILYGVLTQDNVSEATGEAKNAKGVYISTTSGKFTPKIGSIGLHSITENVHPNQQSRFTPVGVAQNENTPFQQWVLPHYAGALALNTNLAPAVAPTFPGEQLLFFRSRVPCVQGLRGRDAFIDCLLPQEWVNHFYQEAAPSQADVALIRYVNPDTGRTLFEAKLHRSGFITVSHTGAYPLVVPPNGHFRFDSWVNQFYSLA

SEQ ID NO: 4081 - protein, 530 aa, Artificial Sequence
  VP1__Norovirus_and/or_Norovirus-like__AB809984
MKMASNDAAPSNDGAASLVPEAINETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFIYLVPPSVESKTKPFTLPILTISELTNSRFPIPIEQLYTAPNENNVVQCQNGRCTLDGELQGTTQLLSSAVCSYRGRTVANSGDNWDQNLLQLTYPSGASYDPTDEVPAPLGTQDFSGILYGVLTQDNVSEGTGEAKNAKGVYISTTSGKFTPKIGSIGLHSITENVHPNQQSRFTPVGVAQNENTPFQQWVLPHYAGALALNTNLAPAVAPTFPGEQLLFFRSRVPCVQGLRGQDAFIDCLLPQEWVNHFYQEAAPSQADVALIRYVNPDTGRTLFEAKLHRSGFITVSHTGAYPLVVPPNGHFRFDSWVNQFYSLA

SEQ ID NO: 4082 - protein, 529 aa, Artificial Sequence
  VP1__Norovirus_and/or_Norovirus-like__KT732276
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAP

SEQ ID NO: 4083 - protein, 529 aa, Artificial Sequence
  VP1__Norovirus_and/or_Norovirus-like__AB810009
MKMASNDAAPSNDGAASLVPEAINETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFIYLVPPSVESKTKPFTLPILTISELTNSRFPIPIEQLYTAPNENNVVQCQNGRCTLDGELQGTTQLLSSAVCSYRGRTVANRGDNWDQNLLQLTYPSGASYDPTDEVPAPLGTQDFSGILYGVLTQDNVSEGTGEAKNAKGVYISTTSGKFTPKIGSIGLHSITENVHPNQQSRFTPVGVAQNENTPFQQWVLPHYAGALALNTNLAPAVAPTFPGEQLLFFRSRVPCVQGLRGQDAFIDCLLPQEWVNHFYQEAAPSQADVALIRYVNPDTGRTLFEAKLHRSGFITVSHTGAYPLVVPPNGHFRFDSWVNQFYSL

SEQ ID NO: 4084 - protein, 529 aa, Artificial Sequence
  VP1__Norovirus_and/or_Norovirus-like__KM461690
MKMASSDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQENTPRMRLVAMLYTPLRANSGEDVFTVSCRVLTRPAPDFEFTFLVPPTVESKTKPFTLPILTLGELSNSRFPAPIDMLYTDPNEGIVVQPQNGRCTLDGTLQGTTQLVPTQICAFRGTLIGQTSRSSDSTDSAPRRRDHPLHVQLKNLDGTQYDPTDEVPAVLGAIDFKGTVFGVASQRDVSGQQVGATRAHEVHINTTDPRYTPKLGSILMHSESDDFVTGQPVRFTPIGMGDNDWHQWELPDYSGRLTLNMNLAPAVAPAFPGERILFFRSIVPSAGGYGSGQIDCLIPQEWVQHFYQEAAPSQSAVALIRYVNPDTGRNIFEAKLHREGFITVANSGNNPIVVPPNGYFRFEAWVN

SEQ ID NO: 4085 - protein, 528 aa, Artificial Sequence
  VP1__Norovirus_and/or_Norovirus-like__JN400618
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPRFESRTKPFSVPVLTVEEMTNSRFPIPLEKLFTGPSSAFVVQPQNGRCTTDGVLLGTTQLSPVNICTFRGDVTHIPGSRNYTMNLASQNWNSYGPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 4086 - protein, 528 aa, Artificial Sequence
  VP1__Norovirus_and/or_Norovirus-like__JQ653095
MKMASNDAAPSNDGAAGLVPEVNNETMALEPVAGASIAAPLTGQNNVIDPWIRLNFVQAHNGEFTVSPRNSPGEVLLNLELGPELNPYLAHLSRMYNGYAGGVEVQVLLAGNAFTAGKLVFAAVPPHFPLENISPGQITMFPHVIIDVRTLEPVLLPLPDVRNNFFHYNQQNEPRMRLVAMLYTPLRSNGSGDDVFTVSCRVPTRPSPDFDFNYLVPPTVESKTKPFTLPILTIGELTNSRFPVPIDELYTSPNESLVVQPQNGRCALDGELQGTTQLLPTAICSFRGRINQKVSGENHVWNMQVTNINGTPFDPTEDVPAPLGTPDFSGKLFGVLSQRDHDNACRSHDAVIATNSAKFTPKLGAIQIGTWEQDDVHINQPTKFTPVGLFESEGFNQWTLPNYSGALTPNMGLAPPVAPTFPGEQILFFRSHIPLKGGVADPVIDCLVPQEWIQHLYQESAPSQTDVALIRFTNPDTGRVLFEAKLHRSGYITVANTGSRPIVVPANGYFRFDSWVNQFYSLAPVGTG

SEQ ID NO: 4087 - protein, 528 aa, Artificial Sequence
  VP1__Norovirus_and/or_Norovirus-like__JN183161
MMMASKDAPSNMDGTSGAGQLVPEVNAAEPLPLEPVVGAATAAATAGQVNLIDPWIMNNFVQAPEGEFTISPNNTPGDILFDLHLGPHLNPFLQHLSQMYNGWVGNMRVRVMLAGNAFTAGKIIICCVPPGFASQNISIGQATMFPHVIADVRVLEPIEIPLDDVRNVLFHTNENRPTMRLLCMLYTPLRAGGASSGTDPFVIAGRVLTCPAPDFNFLFLVPPSVEQKTRQLTVPNIPLNNMANSRVPAMINKMTVSSDQNQVVQFQNGRCTLEGQLLGTTPVSASQVARIRGKVFSTASGKGLNLTELDGTPYHAFESPAPLGFPDIGACDWHVSTFKVDQNLSGDPMSRLDIKQNAPFAPHLGSIEFTSDQDPTGDQLGTLAWVSPSTSGTRVDPWKIPSYGSTVTESTHLAPPIFPPGFGEAIVYFMSDFPIVSGNTAQVPCTLPQEFVSHFVEQQAPIRGEAALLHYVDPDTHRNLGEFKLYPDGFITCVPNTGGGPQNLPTNGVFVFSSWVSRYYQLKPVGTA

SEQ ID NO: 4088 - protein, 528 aa, Artificial Sequence
  VP1__Norovirus_and/or_Norovirus-like__KT906670
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLA

SEQ ID NO: 4089 - protein, 528 aa, Artificial Sequence
  VP1__Norovirus_and/or_Norovirus-like__KT906671
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPTGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLA

SEQ ID NO: 4090 - protein, 528 aa, Artificial Sequence
  VP1__Norovirus_and/or_Norovirus-like__AB810013
MKMASNDAAPSNDGAASLVPEAINETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFIYLVPPSVESKTKPFTLPILTISELTNSRFPIPIEQLYTAPNENNVVQCQNGRCTLDGELQGTTQLLSSAVCSYRGRTVANRGDNWDQNLLQLTYPSGASYDPTDEVPAPLGTQDFSGILYGVLTQDNVSEGTGEAKNAKGVYISTTSGKFTPKIGSIGLHSITENVHPNQQSRFTPVGVAQNENTPFQQWVLPHYAGALALNTNLAPAVAPTFPGEQLLFFRSRVPCVQGLRGQDAFIDCLLPQEWVNHFYQEAAPSQADVALIRYVNPDTGRTLFEAKLHRSGFITVSHTGAYPLVVPPNGHFRFDSWVNQFYS

SEQ ID NO: 4091 - protein, 527 aa, Artificial Sequence
  VP1__Norovirus_and/or_Norovirus-like__EU096510
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTKFTPVGVVQDGNGTHQNEPQQWVLPSYSGRTGHNAHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTL

SEQ ID NO: 4092 - protein, 527 aa, Artificial Sequence
  VP1__Norovirus_and/or_Norovirus-like__EU096513
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFEAHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTL

SEQ ID NO: 4093 - protein, 527 aa, Artificial Sequence
  VP1__Norovirus_and/or_Norovirus-like__EU096514
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTL

SEQ ID NO: 4094 - protein, 527 aa, Artificial Sequence
  VP1__Norovirus_and/or_Norovirus-like__EU096512
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTL

SEQ ID NO: 4095 - protein, 526 aa, Artificial Sequence
  VP1__Norovirus_and/or_Norovirus-like__KU311161
MMMASKDAPSNMDGTSGAGQLVPEVNAAEPLPLEPVVGAATAAATAGQVNMIDPWIMNNFVQAPEGEFTISPNNTPGDILFDLRLGPHLNPFLLHLSQMYNGWVGNMRVRVMLAGNAFSAGKIIICCVPPGFESQNISIGQATMFPHVIADVRVLEPIEVPLDDVRNVLFHTNENRPTMRLLCMLYTPLRAGGASSGTDPFVIAGRVLTCPAPDFNFLFLVPPSVEQKTRQLTIPNIPLNNLANSRVPAMINKMTVSADQNQVVQFQNGRCTLEGQLLGTTPVSANQVARIRGKVFSTNSGTGLNLTEVDGTPYHAFESPAPLGFPDIGNCDWHVYAFKVNQNTGDPMYRLDITQGNSFAPHLGSIEFSSENHPSGDQLGTLTWISPLNNASRVDPWKIPTYGSTLTESTNLAPPIFPPGFGESIVYFMSDFPIVSGNTAQIPCTLPQEFVSSFVEQQAPIRGEAALLHYVDPDTHRNLGEFKLYPDGFITCVPNTGGGPQNLPSNGVFVFSSWVSRYYQLKPVGT

SEQ ID NO: 4096 - protein, 526 aa, Artificial Sequence
  VP1__Norovirus_and/or_Norovirus-like__KX907730
MMMASKDAPSNMDGTSGAGQLVPEVNAAEPLPLEPVVGAATAVATAGQVNMIDPWIMNNFVQAPEGEFTISPNNTPGDILFDLRLGPHLNPFLLHLSQMYNGWVGNMRVRVMLAGNAFSAGKIIICCVPPGFESQNISIGQATMFPHVIADVRVLEPIEVPLDDVRNVLFHTNENRPTMRLLCMLYTPLRAGGASSGTDPFVIAGRVLTCPAPDFNFLFLVPPSVEQKTRQLTIPNIPLNNLANSRVPAMINKMTVSADQNQVVQFQNGRCTLEGQLLGTTPVSANQVARIRGKVFSTNSGTGLNLTEVDGTPYHAFESPAPLGFPDIGNCDWHVYAFKVNQNTGDPMYRLDITQGNSFAPHLGSIEFSSENHPSGDQLGTLTWISPLNNASRVDPWKIPTYGSTLTESTNLAPPIFPPGFGEAIVYFMSDFPIVSGNTAQIPCTLPQEFVSSFVEQQAPIRGEAALLHYVDPDTHRNLGEFKLYPDGFITCVPNTGGGPQNLPSNGVFVFSSWVSRYYQLKPVGT

SEQ ID NO: 4097 - protein, 526 aa, Artificial Sequence
  VP1__Norovirus_and/or_Norovirus-like__EU096507
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPVPLEKLYTGPSSAFVVQPQNGRCTTDGVLLGTTQLSAVNICTFRGDVTHIAGSHDYTMNLASQNWNNYDPTEEIPAPLGTPDFVGKIQGVLTQTTREDGSTRAHKATVSTGSVHFTPKLGSVQYTTDTNNDFQTGQNTKFTPVGVIQDGSNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTL

SEQ ID NO: 4098 - protein, 526 aa, Artificial Sequence
  VP1__Norovirus_and/or_Norovirus-like__AB810007
MKMASNDAAPSNDGAASLVPEAINETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFIYLVPPSVESKTKPFTLPILTISELTNSRFPIPIEQLYTAPNENNVVQCQNGRCTLDGELQGTTQLLSSAVCSYRGRTVANRGDNWDQNLLQLTYPSGASYDPTDEVPAPLGTQDFSGILYGVLTQDNVSEGTGEAKNAKGVYISTTSGKFTPKIGSIGLHSITENVHPNQQSRFTPVGVAQNENTPFQQWVLPHYAGALALNTNLAPAVAPTFPGEQLLFFRSRVPCVQGLRGQDAFIDCLLPQEWVNHFYQEAAPSQADVALIRYVNPDTGRTLFEAKLHRSGFITVSHTGAYPLVVPPNGHFRFDSWVNQF

SEQ ID NO: 4099 - protein, 526 aa, Artificial Sequence
  VP1__Norovirus_and/or_Norovirus-like__AB809989
MKMASNDAAPSNDGAASLVPEAINETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFIYLVPPSVESKTKPFTLPILTISELTNSRFPIPIEQLYTAPNENNVVQCQNGRCTLDGELQGTTQLLSSAVCSYRGRTVANSGDNWDQNLLQLTYPSGASYDPTDEVPAPLGTQDFSGILYGVLTQDNVSEGTGEAKNAKGVYISTTSGKFTPKIGSIGLHSITENVHPNQQSRFTPVGVAQNENTPFQQWVLPHYAGALALNTNLAPAVAPTFPGEQLLFFRSRVPCVQGLRGQDAFIDCLLPQEWVNHFYQEAAPSQADVALIRYVNPDTGRTLFEAKLHRSGFITVSHTGAYPLVVPPNGHFRFDSWVNQF

SEQ ID NO: 4100 - protein, 526 aa, Artificial Sequence
  VP1__Norovirus_and/or_Norovirus-like__AB810000
MKMASNDAAPSNDGAASLVPEAINETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFIYLVPPSVESKTKPFTLPILTISELTNSRFPIPIEQLYTAPNENNVVQCQNGRCTLDGELQGTTQLLSSAVCSYRGRTVANSGDNWDQNLLQLTYPSGASYDPTDEVPAPLGTQDFSGILYGVLTQDNVSEGTGEAKNAKGVYISTTSGKFTPKIGSIGLHSITENVHPNQQSRFTPVGVAQNENTPFQQWVLPHYAGALALNTNLAPAVAPTFPGEQLLFFRSRVPCVQGLRGQDAFIDCLLPQEWVNHFYQEAAPSQADVALIRYVNPDTGRTLFEAKLHRSGFITVSHTGVYPLVVPPNGHFRFDSWVNQF

SEQ ID NO: 4101 - protein, 524 aa, Artificial Sequence
  VP1__Norovirus_and/or_Norovirus-like__AB809999
MKMASNDAAPSNDGAASLVPEAINETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFIYLVPPSVESKTKSFTLPILTISELTNSRFPTPIEQLYTAPNENNVVQCQNGRCTLDGELQGTTQLLSSAVCSYRGRTVANSGDNWDQNLLQLTYPSGASYDPTDEVPAPLGTQDFSGILYGGLTQDNVSEGTGEAKNAKGVYISTTSGKFTPKIGSIGLHSITENVHPNQQSRFTPVGVAQNENTPFQQWVLPHYAGALALNTNLAPAVAPTFPGEQLLFFRSRVPCVQGLRGQDAFIDCLLPQEWVNHFYQEAAPSQADVALIRYVNPDTGRTLFEAKLHRSGFITVSHTGAYPLVVPPNGHFRFDSWVN

SEQ ID NO: 4102 - protein, 523 aa, Artificial Sequence
  VP1__Norovirus_and/or_Norovirus-like__FJ692501
MMMASSDATPPSEGATNLVPEVNTQVVPLEPVAGAAAAAPFTGQNNVIDPWIFQNFVQAPQGEFTVSPRNTPGEILLRIPLGPNLNPFLAHLSRMYNAWVGGMEAEMILAGNAFTAGKLLIVALPPGFEATQLTPAQATAFPHVIADVRTLEPIPIPLPDIRNVLFHYNGDPTPTIQIVVMLYTPLRTNGNGDDVFTVSGRLLTRPAPDFSFSFLVPPTVEQKTRPFTLPNLAVSDLSNSRFPAPVNILRADPNTTLALDYQNGRCTLDGALQGTTPTNSSFLGYLRGTVDRVNSDQVHVHLREPNGDPFQLGLPGPQGVPDYRATLDIYVDWENKNHGNPCEGTLNTGSQTEYTPGLGTLTFNKTSGDTPEQGDPVIMRLVAFRSNLTDQLPAYNGAFGQGENLAPPVSPPVPGEVFLQFGSRYTRLGERELAVQCLLPSEWITHFYSEAAPIQGEAMLLRYVQPDLGRILFEAKLYKEGFVTVAGGTNPVTFPIDGTFVAVSWVSRNFVLSPMGSGQGRRR

SEQ ID NO: 4103 - protein, 523 aa, Artificial Sequence
  VP1__Norovirus_and/or_Norovirus-like__FJ692500
MMMASSDATPPSEGATNLVPEVNTQVVPLEPVAGAAAAAPFTGQNNVIDPWIFQNFVQAPQGEFTVSPRNTPGEILLRIPLGPNLNPFLAHLSRMYNAWVGGMEAEMILAGNAFTAGKLLIVALPPGFEATQLTPAQATAFPHVIADVRTLEPIPIPLPDIRNVLFHYNGDPTPTIQIVVMLYTPLRTNGNGDDVFTVSGRLLTRPAPDFSFSFLVPPTVEQKTRSFTLPNLAVSDLSNSRFPAPVNILRADPNTTLALDYQNGRCTLDGALQGTTPTNSSFLGYLRGTVDRVNSDQVHVHLREPNGDPFQLGLPGPQGVPDYRATLDIYVDWENKNHGNPCEGTLNTGSQTEYTPGLGTLTFNKTSGDTPEQGDPVIMRLVAFRSNLTDQLPAYNGAFGQGENLAPPVSPPVPGEVFLQFGSRYTRLGERELAVQCLLPSEWITHFYSEAAPIQGEAMLLRYVQPDLGRILFEAKLYKEGFVTVAGGTNPVTFPIDGTFVAVSWVSRNFVLSPMGSGQGRRR

SEQ ID NO: 4104 - protein, 523 aa, Artificial Sequence
  VP1__Norovirus_and/or_Norovirus-like__AB031013
MMMASKDATSSVDGASGAGQLVPEVNASDPLAMDPVAGSSTAVATAGQVNPIDPWIINNFVQAPQGEFTISPNNTPGGVLFDLSLGPHLNPFLLHLSQMYNGWVGNMRVRIMLAGNAFTAGKIIVSCIPPGFGSHNLTIAQATLFPHVIADVRTLDPIEVPLEDVRNVLFHNNDRNQQTMRLVCMLYTPLRTGGGTGDSFVVAGRVMTCPSPDFNFLFLVPPTVEQKTRPFTLPNLPLSSLSNSRAPLPISGMGISPDNVQSVQFQNGRCTLDGRLVGTTPVSLSHVAKIRGTSNGTVINLTELDGTPFHPFEGPAPIGFPDLGGCDWHINMTQFGHSSQTQYDVDTTPDTFVPHLGSIQANGIGSGNYIGVLSWVSPPSHPSGSQVDLWKIPNYGSSITEATHLAPSVYPPGFGEVLVFFMSKIPGPGAYSLPCLLPQEYISHLASEQAPTVGEAALLHYVDPDTGRTLGEFKAYPDGFLTCVPNGASSGPQQLPINGVFVFVSWVSRFYQLKPVGTASSAR

SEQ ID NO: 4105 - protein, 523 aa, Artificial Sequence
  VP1__Norovirus_and/or_Norovirus-like__KU253442
MMMASKDATSSVDGASGAGQLVPEVNASDPLAMDPVAGSSTAVATAGQVNPIDPWIINNFVQAPQGEFTISPNNTPGDVLFDLSLGPHLNPFLLHLSQMYNGWVGNMRVRIMLAGNAFTAGKIIVSCIPPGFGSHNLTIAQATLFPHVIADVRTLDPIEVPLEDVRNVLFHNNDRNQQTMRLVCMLYTPLRTGGGTGDSSVVAGRVMTCPSPDFNFLFLVPPTVEQKTRPFTLPNLPLSSLSNSRAPLPISSMGISPDNVQSVQLQNGRCTLDGRLVGTTPVSLSHVAKIRGTSNGTAINLTELDGTPFHPFEGPAPIGLPDLGGCDRHINMTQFGHSSQTQHDADTTPDTSVPHLGSIQANGIGSGNYVGVLSWISPPSHPSGSQVDLWKIPNYGSSITEATHLAPSVYPPGFGEVLVFFMSKMPGPGAYNLPCLLPQEYISHLASEQAPTVGEAALLHYVDPDTGRNLGEFKAYPDGFLTCVPNGASSGPQQLPINGVFVFVSWVSRFYQLKPVGTASSAR

SEQ ID NO: 4106 - protein, 523 aa, Artificial Sequence
  VP1__Norovirus_and/or_Norovirus-like__EF547392
MMMASKDATSSVDGASGAGQLVPEVNASDPLAMDPVAGSSTAVATAGQVNPIDPWIINNFVQAPQGEFTISPNNTPGDVLFDLSLGPHLNPFLLHLSQMYNGWVGNMRVRIMLAGNAFTAGKIIVSCIPPGFGSHNLTIAQATLFPHVIADVRTLDPIEVPLEDVRNVLFHNNDRNQQTMRLVCMLYTPLRTGGGTGDSFVVAGRVMTCPSPDFNFLFLVPPTVEQKTRPFTLPNLPLSSLSNSRAPLPISGMGISPDNVQSVQFQNGRCTLDGRLVGTTPVSLSHVAKIRGTSNGTVINLTELDGTPFHPFEGPAPIGFPDLGGCDWHINMTQFGHSSQTQYDVDTTPDTFVPHLGSIQANGVSSGNYIGVLSWVSPPSHPSGSQVDLWKIPNYGSSITEATHLAPSVYPPGFGEVLVFFMSKIPGPGAYSLPCLLPQEYISHLASEQAPTVGEAALLHYVDPDTGRNLGEFKAYPDGFLTCVPNGASSGPQQLPINGVFVFVSWVSRFYQLKPVGTASTAR

SEQ ID NO: 4107 - protein, 523 aa, Artificial Sequence
  VP1__Norovirus_and/or_Norovirus-like__KT943503
MMMASKDATSSVDGASGAGQLVPEVNASDPLAMDPVAGSSTAVATAGQVNPIDPWIINNFVQAPQGEFTISPNNTPGDVLFDLSLGPHLNPFLLHLSQMYNGWVGNMRVRIMLAGNAFTAGKIIVSCIPPGFGSHNLTIAQATLFPHVIADVRTLDPIEVPLEDVRNVLFHNNDRNQQTMRLVCMLYTPLRTGGGTGDSFVVAGRVMTCPSPDFNFLFLVPPTVEQKTRPFTLPNLPLSSLSNSRAPLPISSMGISPDNVQSVQFQNGRCTLDGRLVGTTPVSLSHVAKIRGTSNGTVINLTELDGTPFHPFEGPAPIGFPDLGGCDWHINMTQFGHSSQTQYDVDTTPDTFVPHLGSIQANGIGSGNYVGVLSWISPPSHPSGSQVDLWKIPNYGSSITEATHLAPSVYPPGFGEVLVFFMSKMPGPGAYNLPCLLPQEYISHLASEQAPTVGEAALLHYVDPDTGRNLGEFKAYPDGFLTCVPNGASSGPQQLPINGVFVFVSWVSRFYQLKPVGTASSAR

SEQ ID NO: 4108 - protein, 523 aa, Artificial Sequence
  VP1__Norovirus_and/or_Norovirus-like__AY502016
MMMASKDATSNVDGASGAGQLVPEANTSDPLAMDPVAGSSTAVATAGQVNPIDPWIINNFVQAPQGEFTISPNNTPGDVLFDLSLGPHLNPFLLHLSQMYNGWVGNMRVRIMLAGNAFTAGKIIVSCIPPGFGSHNLTIAQSTLFPHVIADVRTLDPIEVPLEDVRNVLFHNNDRNQQTMRLVCMLYTPLRTGGGTGDSFVVAGRVMTCPSPDFNFLFLVPPTVEQKTRPFTLPNLPLSSLSNSRAPLPISSMGISPDNVQSVQFQNGRCTLDGRLVGTTPVSLSQVAKIRGTSNGTVINLTELDGTPFHPFEGPAPIGFPDLGGCDWHVNMTQFGHSSQTQFDVDTTPETFVPHLGSIQANGVGSGNYIGVLSWISPPSHPSGSQVDLWKIPNYGSSITEATHLAPSVFPPGFGEVLVFFMSKIPGPGAYNLPCLLPQEYISHFASEQAPTVGEAALLHYVDPDTGRNLGEFKAYPDGFLTCVPNGASSGPQQLPINGVFVFVSWVSRFYQLKPVGTASSAR

SEQ ID NO: 4109 - protein, 523 aa, Artificial Sequence
  VP1__Norovirus_and/or_Norovirus-like__KU253446
MMMASKDATSSVDGASGAGQLVPEVNASDPLAMDPVAGSSTAVATAGQVNPIDPWIINNFVQAPQGEFTISPNNTPGDVLFDLSLGPHLNPFLLHLSQMYNGWVGNMRVRIMLAGNAFTAGKIIVSCIPPGFGSHNLTIAQATLFPHVIADVRTLDPIEVPLEDVRNVLFHNNDRNQQTMRLVCMLYTPLRTGGGTGDSFVVAGRVMTCPSPDFNFLFLVPPTVEQKTRPFTLPNLPLSSLSNSRAPLPISSMGISPDNVQSVQFQNGRCTLDGRLVGTTPVSLSHVAKIRGTSNGTVINLTELDGTPFHPFEGPAPIGFPDLGGCDWHINMTQFGHSSQTQYDVDTTPDTFVPHLGSIQANGIGSGNYVGVLSWISPPSHPSGSQVDLWKIPNYGSSITEATHLAPSVYPPGFGEVLVFFMSKMPGPGAYNLPCLLPQEYISHLASEQAPTVGEAALLHYVDPDTGRNLGEFKAYPDGFLTCVPNGASSGPQQLPIIGVFVFVSWVSRFYQLKPVGTASSAR

SEQ ID NO: 4110 - protein, 523 aa, Artificial Sequence
  VP1__Norovirus_and/or_Norovirus-like__KU253445
MMMASKDATSSVDGASGAGQLVPEVNASDPLAMDPVAGSSTAVATAGQVNPIDPWIINNFVQAPQGEFTISPNNTPGDVLFDLSLGPHLNPFLLHLSQMYNGWVGNMRVRIMLAGNAFTAGKIIVSCIPPGFGSHNLTIAQATLFPHVIADVRTLDPIEVPLEDVRNVLFHNNDRNQQTMRLVCMLYTPLRTGGGTGDSFVVAGRVMTCPSPDFNFLFLVPPTVEQKTRPFTLPNLPLSSLSNSLAPLPISSMGISPDNVQSVQFQNGRCTLDGRLVGTTPVSLSHVAKIRGTSNGTVINLTELDGTPFHPFEGPAPIGFPDLGGCDWHINMTQFGHSSQTQYDVDTTPDTFVPHLGSIQANGIGSGNYVGVLSWISPPSHPSGSQVDLWKIPNYGSSITEATHLAPSVYPPGFGEVLVFFMSKMPGPGAYNLPCLLPQEYISHLASEQAPTVGEAALLHYVDPDTGRNLGEFKAYPDGFLTCVPNGASSGPQQLPINGVFVFVSWVSRFYQLKPVGTASSAR

SEQ ID NO: 4111 - protein, 523 aa, Artificial Sequence
  VP1__Norovirus_and/or_Norovirus-like__KF039735
MMMASKDATSSVDGASGAGQLVPEVNASDPLAMDPVAGSSTAVATTGQVNPIDPWIINNFVQAPQGEFTISPNNTPGDVLFDLSLGPHLNPFLLHLSQMYNGWVGNMRVRIMLAGNAFTAGKIIVSCIPPGFGSHNLTIAQATLFPHVIADVRTLDPIEVPLEDVRNVLFHNNDRNQQTMRLVCMLYTPLRTGGGTGDSFVVAGRVMTCPSPDFNFLFLVPPTVEQKTRPFTLPNLPLSSLSNSRAPLPISSMGISPDNVQSVQFQNGRCTLDGRLVGTTPVSLSHVAKIRGTSNGTVINLTELDGTPFHPFEGPAPIGFPDLGGCDWHINMTQFGHSSQTQYDVDTTPDTFVPHLGSIQANGIGSGNYVGVLSWISPPSHPSGSQVDLWKIPNYGSSITEATHLAPSVYPPGFGEVLVFFMSKMPGPGAYNLPCLLPQEYISHLASEQAPTVGEAALLHYVDPDTGRNLGEFKAYPDGFLTCVPNGASSGPQQLPINGVFVFVSWVSRFYQLKPVGTASSAR

SEQ ID NO: 4112 - protein, 523 aa, Artificial Sequence
  VP1__Norovirus_and/or_Norovirus-like__KF039732
MMMASKDATSSVDGASGAGQLVPEVNASDPLAMDPVAGSSTAVATAGQVNPIDPWIINNFVQAPQGEFTISPNNTPGDVLFDLSLGPHLNPFLLHLSQMYNGWVGNMRVRIMLAGNAFTAGKIIVSCIPPGFGSHNLTIAQATLFPHVIADVRTLDPIEVPLEDVRNVLFHNNDRNQQTMRLVCMLYTPLRTGGGTGDSFVVAGRVMTCPSPDFNFLFLVPPTVEQKTRPFTLPNLPLSSLSNSRAPLPISSMGISPDNVQSVQFQNGRCTLDGRLVGTTPVSLSHVAKIRGTSNGTVINLTELDGTPFHPFEGPAPIGFPDLGGCDWHINMTQFGHSSQTQYDVDTTPVTFVPHLGSIQANGIGSGNYVGVLSWISPPSHPSGSQVDLWKIPNYGSSITEATHLAPSVYPPGFGEVLVFFMSKMPGPGAYNLPCLLPQEYISHLASEQAPTVGEAALLHYVDPDTGRNLGEFKAYPDGFLTCVPNGASSGPQQLPINGVFVFVSWVSRFYQLKPVGTASSAR

SEQ ID NO: 4113 - protein, 523 aa, Artificial Sequence
  VP1__Norovirus_and/or_Norovirus-like__KF039734
MMMASKDATSSVDGASGAGQLVPEVNASDPLAMDPVAGSSTAVATAGQVNPIDPWIINNFVQAPQGEFTISPNNTPGDVLFDLSLGPHLNPFLLHLSQMYNGWVGNMRVRIMLAGNAFTAGKIIVSCIPPGFGSHNLTIAQATLFPHVIADVRTLDPIEVPLEDVRNVLFHNNDRNQQTMRLVCMLYTPLRTGGGTGDSFVVAGRVMTCPSPDFNFLFLVPPTVEQKTRPFTLPNLPLSSLSNSRAPLPISSMGISPDNVQSVQFQNGRCTLDGRLVGTTPVSLSHVAKIRGTSNGTVINLTELDGTPFHPFEGPAPIGFPDLGGCDWHINMTQFGHSSQTQYDVDTTPDTFVPHLGSIQANGIGSGNYVGVLSWISPPSRPSGSQVDLWKIPNYGSSITEATHLAPSVYPPGFGEVLVFFMSKMPGPGAYNLPCLLPQEYISHLASEQAPTVGEAALLHYVDPDTGRNLGEFKAYPDGFLTCVPNGASSGPQQLPINGVFVFVSWVSRFYQLKPVGTASSAR

SEQ ID NO: 4114 - protein, 523 aa, Artificial Sequence
  VP1__Norovirus_and/or_Norovirus-like__KF039729
MMMASKDATSSVDGASGAGQLVPEVNASDPLAMDPVAGSSTAVATAGQVNPIDPWIINNFVQAPQGEFTISPNNTPGDVLFDLSLGPHLNPFLLHLSQMYNGWVGNMRVRIMLAGNAFTAGKIIVSCIPPGFGSHNLTIAQATLFPHVIADVRTLDPIEVPLEDVRNVLFHNNDRNQQTMRLVCMLYTPLRTGGGTGDSFVVAGRVMTCPSPDFNFLFLVPPTVEQKTRPFTLPNLPLSSLSNSRAPLPISSMGISPDNVQSVQFQNGRCTLDGRLVGTTPVSLSHVAKIRGTSNGTVINLTELDGTPFHPFEGPAPIGFPDLGGCDWHINMTQFGHSSQTQYDVDTTPDTFVPHLGSIQANGVGSGNYVGVLSWISPPSHPSGSQVDLWKIPNYGSSITEATHLAPSVYPPGFGEVLVFFMSKMPGPGAYNLPCLLPQEYISHLASEQAPTVGEAALLHYVDPDTGRNLGEFKAYPDGFLTCVPNGASSGPQQLPINGVFVFVSWVSRFYQLKPVGTASSAR

SEQ ID NO: 4115 - protein, 523 aa, Artificial Sequence
  VP1__Norovirus_and/or_Norovirus-like__KF039737
MMMASKDATSSVDGASGAGQLVPEVNASDPLAMDPVAGSSTAVATAGQVNPIDPWIINNFVQAPQGEFTISPNNTPGDVLFDLSLGPHLNPFLLHLSQMYNGWVGNMRVRIMLAGNAFTAGKIIVSCIPPGFGSHNLTIAQATLFPHVIADVRTLDPIEVPLEDVRNVLFHNNDRNQQTMRLVCMLYTPLRTGGGTGDSFVVAGRVMTCPSPDFNFLFLVPPTVEQKTRPFTLPNLPLSSLSNSRAPLPISSMGISPDNVQSVQFQNGRCTLDGRLVGTTPVSLSHVAKIRGTSNGTVINLTELDGTPFHPFEGPAPIGFPDLGGCDWHINMTQFGHSSQTQYDVNTTPDTFVPHLGSIQANGIGSGNYVGVLSWISPPSHPSGSQVDLWKIPNYGSSITEATHLAPSVYPPGFGEVLVFFMSKMPGPGAYNLPCLLPQEYISHLASEQAPTVGEAALLHYVDPDTGRNLGEFKAYPDGFLTCVPNGASSGPQQLPINGVFVFVSWVSRFYQLKPVGTASSAR

SEQ ID NO: 4116 - protein, 523 aa, Artificial Sequence
  VP1__Norovirus_and/or_Norovirus-like__KF039731
MMMASKDATSSVDGASGAGQLVPEVNASDPLAMDPVAGSSTAVATAGQVNPIDPWIINNFVQAPQGEFTISPNNTPGDVLFDLSLGPHLNPFLLHLSQMYNGWVGNMRVRIMLAGNAFTAGKIIVSCIPPGFGSHNLTIAQATLFPHVIADVRTLDPIEVPLEDVRNVLFHNNDRNQQTMRLVCMLYTPLRTGGGTGDSFVVAGRVMTCPSPDFNFLFLVPPTVEQKTRPFTLPNLPLSSLSNSRAPLPISSMGISPDNVQSVQFQNGRCTLDGRLVGTTPVSLSHVAKIRGTSNGTVINLTELDGTPFHPFEGPAPIGFPDLGGCDWHINMTQFGHSSQTQYDVDTTPDIFVPHLGSIQANGIGSGNYVGVLSWISPPSHPSGSQVDLWKIPNYGSSITEATHLAPSVYPPGFGEVLVFFMSKMPGPGAYNLPCLLPQEYISHLASEQAPTVGEAALLHYVDPDTGRNLGEFKAYPDGFLTCVPNGASSGPQQLPINGVFVFVSWVSRFYQLKPVGTASSAR

SEQ ID NO: 4117 - protein, 520 aa, Artificial Sequence
  VP1__Norovirus_and/or_Norovirus-like__KT732279
MMMASKDATSSVDGASGAGQLVPEVNASDPLAMDPVAGSSTAVATAGQVNPIDPWIINNFVQAPQGEFTISPNNTPGDVLFDLSLGPHLNPFLLHLSQMYNGWVGNMRVRIMLAGNAFTAGKIIVSCIPPGFGSHNLTIAQATLFPHVIADVRTLDPIEVPLEDVRNVLFHNNDRNQQTMRLVCMLYTPLRTGGGTGDSLVVAGRVMTCPSPDFNFLFLVPPTVEQKTRPFTLPNLPLSSLSNSRAPLPISGMGISPDNVQSVQFQNGRCTLDGRLVGTTPVSLSHVAKIRGTSNGTVINLTELDGTPFHPFEGPAPIGFPDLGGCDWHINMTQFGHSSQTQYDVDTTPDTFVPHLGSIQANGINSGNYIGVLSWVSPPSHPSGSQVDLWKIPNYGSSITEATHLAPSVFPPGFGEVLVFFMSKIPGPGAYSLPCLLPQEYISHLASEQAPTVGEAALLHYVDPDTGRNLGEFKAYPDGFLTCVPNGASSGPQQLPINGVFVFVSWVSRFYQLKPVGTAS

SEQ ID NO: 4118 - protein, 520 aa, Artificial Sequence
  VP1__Norovirus_and/or_Norovirus-like__FJ384783
MMMASKDATSSVDGASGAGQLVPEVNASDPLAMDPVAGSSTAVATAGQVNPIDPWIINNFVQAPQGEFTISPNNTPGDVLFDLSLGPHLNPFLLHLSQMYNGWVGNMRVRIMLAGNAFTAGKIIVSCIPPGFGSHNLTIAQATLFPHVIADVRTLDPIEVPLEDVRNVLFHNNDRNQQTMRLVCMLYTPLRTGGGTGDSFVVAGRVMTCPSPDFNFLFLVPPTVEQKTRPFTLPNLPLSSLSNSRAPLPISGMGISPDNVQSVQFQNGRCTLDGRLVGTTPVSLSHVAKIRGTSNGTVINLTELDGTPFHPFEGPAPIGFPDLGGCDWHINMTQFGHSSQTQYDVDTTPDTFVPHLGSIQANGINSGNYIGVLSWVSPPSHPSGSQVDLWKIPNYGSSITEATHLAPSVFPPGFGEVLVFFMSKIPGPGAYSLPCLLPQEYISHLASEQAPTVGEAALLHYVDPDTGRNLGEFKAYPDGFLTCVPNGASSGPQQLPINGVFVFVSWVSRFYQLKPVGTAS

SEQ ID NO: 4119 - protein, 520 aa, Artificial Sequence
  VP1__Norovirus_and/or_Norovirus-like__EU085522
MMMASKDATSSVDGASGAGQLVPEVNASDPLAMDPVAGSSTAVATAGQVNPIDPWIINNFVQAPQGEFTISPNNTPGDVLFDLSLGPHLNPFLLHLSQMYNGWVGNMRVRIMLAGNAFTAGKIIVSCIPPGFGSHNLTIAQATLFPHVIADVRTLDPIEVPLEDVRNVLFHNNDRNQQTMRLVCMLYTPLRTGSGTGDSFVVAGRVMTCPSPDFNFLFLVPPTVEQKTRPFTLPNLPLSSLSNSRAPLPISGMGISPDNVQSVQFQNGRCTLDGRLVGTTPVSLSHVAKIRGTSNGTVINLTELDGTPFHPFEGPAPIGFPDLGGCDWHINMTQFGHSSQTQYDVDTTPDTFVPHLGSIQANGINSGNYIGVLSWVSPPSHPSGSQVDLWKIPNYGSSITEATHLAPSVFPPGFGEVLVFFMSKIPGPGAYSLPCLLPQEYISHLASEQAPTVGEAALLHYVDPDTGRNLGEFKAYPDGFLTCVPNGASSGPQQLPINGVFVFVSWVSRFYQLKPVGTAS

SEQ ID NO: 4120 - protein, 520 aa, Artificial Sequence
  VP1__Norovirus_and/or_Norovirus-like__L23828
MMMASKDATSSVDGASASVQLVPEVNASDPLAMDPVAGSSTAVATAGQVNPIDPWIINNFVQAPQGEFTISPNNTPGDVLFDLSLGPHLNPFLLHLSQMYNGWVGNMRVRIMLAGNAFTAGKIIVSCIPPGFGSQQLTIAQATLFPHVIADVRTLDPIEVPLEDVRNVLFHNNDRNQQTMRLVCMLYTPLSTGGGTGDSFVVAGRVMTCPSPDFNFLFLVPPTVEQKTRPFTLPNLPLSSLSNSRAPLPISGMGISPDNVQSVQFQNGRCTLDGRLVGTTPVSLSHVAKIRGTSNGTVINLTELDGTPFHPFEGPAPIGFPDLGGCDWHINMTQFGHSSQTQYDVDTTPDTSVPHLGSIQANGIGSGNYIGVLSWVSPPSHPSGSQVDLWKIPNYGSSITEATHLAPSVYSPGFGEVLVFFMSKIPGPGGDSLPCLLPQGYISHLASEQAPTVGEGPLLHYVDPDTDRNLGEFKAYPDGFLTCVPNGASSGPQQLPINGVFVFVSWVSRFYQLKPVGTAS

SEQ ID NO: 4121 - protein, 520 aa, Artificial Sequence
  VP1__Norovirus_and/or_Norovirus-like__KX764843
MKMASNDAAPSNDGAAGLVPEGNNETLPLEPVAGAAIAAPVTGQNNIIDPWIRTNFVQAPNGEFTVSPRNSPGEVLLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDAW

SEQ ID NO: 4122 - protein, 520 aa, Artificial Sequence
  VP1__Norovirus_and/or_Norovirus-like__KX764841
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWRMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGGYPLVVPANGHFRFESW

SEQ ID NO: 4123 - protein, 520 aa, Artificial Sequence
  VP1__Norovirus_and/or_Norovirus-like__KX764840
MKMASSDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSW

SEQ ID NO: 4124 - protein, 520 aa, Artificial Sequence
  VP1__Norovirus_and/or_Norovirus-like__KT864687
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFESW

SEQ ID NO: 4125 - protein, 520 aa, Artificial Sequence
  VP1__Norovirus_and/or_Norovirus-like__KX764842
MKMASNDVAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDAW

SEQ ID NO: 4126 - protein, 520 aa, Artificial Sequence
  VP1__Norovirus_and/or_Norovirus-like__KT864685
MKMASSDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGPVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSW

SEQ ID NO: 4127 - protein, 520 aa, Artificial Sequence
  VP1__Norovirus_and/or_Norovirus-like__KT864684
MKMASSDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFESW

SEQ ID NO: 4128 - protein, 520 aa, Artificial Sequence
  VP1__Norovirus_and/or_Norovirus-like__KX764836
MKMASSDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGVIDCLIPQEWIQHFYQESAPSQSDVALIRYVNPDTGRTLFEAKLHRSGYITVAHSGDYPLVVPANGHFRFEAW

SEQ ID NO: 4129 - protein, 520 aa, Artificial Sequence
  VP1__Norovirus_and/or_Norovirus-like__KX764845
MKMASSDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSLQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFEAW

SEQ ID NO: 4130 - protein, 520 aa, Artificial Sequence
  VP1__Norovirus_and/or_Norovirus-like__KX764837
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGATQLLPSGICAFRGRVTAQINQRDRWHMQLQNLNGTTYDPTDDVPAPLGTPDFKGVVFGMVSQRNVGNDVPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGVIDCLIPQEWIQHFYQESAPSQSDVALIRYVNPDTGRTLFEAKLHRSGYITVAHSGDYPLVVPANGHFRFDAW

SEQ ID NO: 4131 - protein, 520 aa, Artificial Sequence
  VP1__Norovirus_and/or_Norovirus-like__KX764838
MKMASNDAAPSNDGAAGLVPEGNNETLPLEPVAGAAIAAPVTGQNNIIDPWIRTNFVQAPNGEFTVSPRNSPGEILLNLELGPDLSPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQVVPSGICAFRGRVTAQINQRDRWHMQLQNLNSTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYIAVAHSGDYPLVVPANGHFRFDSW

SEQ ID NO: 4132 - protein, 520 aa, Artificial Sequence
  VP1__Norovirus_and/or_Norovirus-like__KU687016
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSFRVLTRPTPDFEFTYLVPPSVESRTKPFSLPILTLSELTNSRFPVPIDSLFTAQNNVLQVQCQNGRCTLDGELQGTTQLLPSGICAFRGQVTAQINQRDRWHMQLQNLNGTTYDPTDDVPAPLGTPDFKGVVFGMVSQRNVGNDAPGSTRAQQAWVSTYSPQFVPKLGSINLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDAW

SEQ ID NO: 4133 - protein, 520 aa, Artificial Sequence
  VP1__Norovirus_and/or_Norovirus-like__KU687015
MKMASSDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVLPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDPLFTAQNNVLQVQCQNGRCTLDGELQGTTQLLPSGICAFRGRVTAQINQRDRWHIQLQNLNGTTYDPTDDVPAPLGTPDFKGVVFGMVSQRNVGNDAPGSTRAQQAWVSTYSPQFVPKLGSINLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDAW

SEQ ID NO: 4134 - protein, 520 aa, Artificial Sequence
  VP1__Norovirus_and/or_Norovirus-like__KU687013
MKMASSDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGGDVFTVSCRVLTRPTPDFEFTYLVPPSVKSKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSINLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFESW

SEQ ID NO: 4135 - protein, 520 aa, Artificial Sequence
  VP1__Norovirus_and/or_Norovirus-like__KX764839
MKMASSDAAPSNDGAAGLVPEGNNETLPLEPVAGTAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLGPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFEAW

SEQ ID NO: 4136 - protein, 520 aa, Artificial Sequence
  VP1__Norovirus_and/or_Norovirus-like__KX764844
MKMASNDAAPSNDGAAGLVPEGNNGTLPLEPVAGAAIAAPVTGQNNIIDPWIRINFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMGLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFESW

SEQ ID NO: 4137 - protein, 520 aa, Artificial Sequence
  VP1__Norovirus_and/or_Norovirus-like__KT864686
MKMASSDAAPSNDGAAGLVPEGNNETLPLEPVVGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSDGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGGQLLFFRSFVPCSGGYNQGIIDCLIPQEWIQHFYQESAPSQSDVALIRYVNPDTGRTLFEAKLHRSGYITVAHSGDYPLVVPANGHFRFESW

SEQ ID NO: 4138 - protein, 520 aa, Artificial Sequence
  VP1__Norovirus_and/or_Norovirus-like__KU687012
MKMASSDAAPSNDGAAGLVPEINTETLPLEPVAGAAIAAPVTGQNNIIDPWIRNNFVQAPNGEFTVSPRNSPGEILMNLELGPDLNPYLAHLSRMYNGYAGGVEVQVLLAGNAFTAGKILFAAVPPNFPVDMLSPAQITMLPHLTVDVRTLEPIMIPLPDVRNVFYHFNNQPAPRMRLVAMLYTPLRSNGSGDDVFTVSCRVLTRPTPDFEFTYLVPPSVESKTKPFTLPILTIGELTNSRFPAPIDQLYTSPNTDILVQPQNGRCTLDGELQGTTQLLTTAICSYRGTTSNPTSDYWDDHLLHLVHPNGATYDPTEDVPAPFGTQDFRGILYGVLTQNTQSPRDEVSNSRGIYISSTSDKFTPKLGTIGLHQVQGDTASNQQSKFTPVGIAVNQNTPFKQWELPNYSGALTLNTNLAPAVGPNFPGEQILFFRSNVPSVQGTHPTQEIDCLIPQEWISHFYQESAPSQSDVALVRYVNPDTGRTIFEAKLHRQGFITIAATGSNPVVVPPNGYFRFDSW

SEQ ID NO: 4139 - protein, 520 aa, Artificial Sequence
  VP1__Norovirus_and/or_Norovirus-like__KU687018
MKMASNDAAPSNDGAAGLVPEINTETLPLEPVAGAAIAAPVTGQNNIIDPWIRNNFVQAPNGEFTVSPRNSPGEILMNLELGPDLNPYLAHLSRMYNGYARGVEVQVLLAGNAFTAGKILFAAVPPNFPVDMLSPAQITMLPHLIVDVRTLEPIMIPLPDVRNVFYHFNNQPAPRMRLVAMLYTPLRSNGSGDDVFTVSCRVLTRPTPDFEFTYLVPPSVESKTKPFTLPILTIGELTNSRFPAPIDQLYTSPNADVVVQPQNGRCTLDGELQGTTQLLTTAICSYRGTTSNPTSDYWDDHLLHLVHPNGATYDPTEDVPAPFGTQDFRGILYGVLTQNTQNPRDEVSNSRGIYISSTSDKFTPKLGTIGLHQVQGDTASNQQSKFTPVGIAVNQNTPFKQWELPNYSGALTLNTNLAPAVGPNFPGEQILFFRSNVPSVQGNHPTQEIDCLIPQEWVSHFYQESAPSQSDVALVRYVNPDTGRTIFEAKLHRQGFITIAATGSNPVVVPPNGYFRFESW

SEQ ID NO: 4140 - protein, 520 aa, Artificial Sequence
  VP1__Norovirus_and/or_Norovirus-like__KU687021
MKMASNDATPSNDGAAGLVPEINTETLPLEPVAGAAIAAPVTGQNNIIDPWIRNNFVQAPNGEFTVSPRNSPGEILMNLELGPDLNPYLAHLSRMYNGYAGGVEVQVLLAGNAFTAGKILFAAVPPNFPVDMLSPAQITMLPHLIVDVRTLEPIMIPLPDVRNVFYHFNNQPAPRMRLVAMLYTPLRSNGSGDDVFTVSCRVLTRPTPDFEFTYLVPPSVESKTKPFTLPILTIGELTNSRFPAPIDQLYTSPNADVVVQPQNGRCTLDGELQGTTQLLTTAICSYRGTTSNPTSDYWDDHLLHLVHPNGATYDPTEDVPAPFGTQDFRGILYGVLTQNTQNPRDKVSNSRGIYISSTSDKFTPKLGTIGLHQVQGDTASNQQSKFTPVGIAVNQNTPFKQWELPNYSGALTLNTNLAPAVGPNFPGEQILFFRSNVPSVQGNHPTQEIDCLIPQEWVSHFYQESAPSQSDVALVRYVNPDTGRTIFEAKLHRQGFIIIAATGSNPVVVPPNGYFRFESW

SEQ ID NO: 4141 - protein, 520 aa, Artificial Sequence
  VP1__Norovirus_and/or_Norovirus-like__KU687020
MKMASSDAAPSNDGAAGLVPEINTETLPLEPVAGAAIAAPVTGQNNIIDPWIRNNFVQAPNGEFTVSPRNSPGEILMNLELGPDLNPYLAHLSRMYNGYAGGVEVQVLLAGNAFTAGKILFAAVPPNFPVDMLSPAQITMLPHLIVDVRTLEPIMIPLPDVRNVFYHFNNQPAPRMRLVAMLYTPLRSNGSGDDVFTVSCRVLTRPTPDFEFTYLVPPSVESKTKPFTLPILTIGELTNSRFPAPIDQLYASPNADVVVQPQNGRCTLDGELQGTTQLLTTAICSYRGTTSNPTSDYWDDHLLHLVHPNGATYDPTEDVPAPFGTQDFRGILYGVLTQNTQNPRDEVSNSRGIYISSTSDKFTPKLGTIGLHQVQGDTASNQQSKFTPVGIAVNQNTPFKQWELPNYSGALTLNTNLAPAVGPNFPGEQILFFRSNVPSVQGNHPTQEIDCLIPQEWVSHFYQESAPSQSDVALVRYVNPDTGRTIFEAKLHRQGFITIAATGSNPVVVPPNGYFRFDAW

SEQ ID NO: 4142 - protein, 520 aa, Artificial Sequence
  VP1__Norovirus_and/or_Norovirus-like__KU687014
MKMASNDAAPSNDGAAGLVPEINTETLPLEPVAGAAIAAPVTGQNNIIDPWIRNNFVQAPNGEFTVSPRNSPGEILMNLELGPDLNPYLAHLSRMYNGYAGGVEVQVLLAGNAFTAGKILFAAVPPNFPVDMLIPAQITMLPHLIVDVRTLEPIMIPLPDVRNVFYHFNNQPAPRMRLVAMLYTPLRSNGSGDDVFTVSCRVLTRPTPDFEFTYLVPPSVESKTKPFTLPILTIGELTNSRFPAPIDQLYTSPNADVVVQPQNGRCTLDGELQGTTQLLTTAICSYRGTTSNPTSDYWDDHLLHLVHPNGATYGPTEDVPAPFGTQDFRGILYGVLTQNTQNPRDEVSNSRGIYISSTSDKFTPKLGTIGLHQVQGDTASNQQSKFTPVGIAVNQNTPFKQWELPNYSGALTLNTNLAPAVGPNFPGEQILFFRSNVPSVQGTHPTQEIDCLIPQEWISHFYQESAPSQSDVALVRYVNPDTGRTIFEAKLHRQGFITIAATGSNPVVVPPNGYFRFDAW

SEQ ID NO: 4143 - protein, 520 aa, Artificial Sequence
  VP1__Norovirus_and/or_Norovirus-like__KU687019
MKMASNDAAPSNDGAAGLVPEINTETLPLEPVAGAAIAAPVTGQNNIIDPWIRNNFVQAPNGEFTVSPRNSPGEILMNLELGPDLNPYLAHLSRMYNGYAGGVEVQVLLAGNAFTAGKILFAAVPPNFPVDMLSPAQITMLPHLIVDVRTLEPIMIPLPDVRNVFYHFNNQPAPRMRLVAMLYTPLRSNGSGDDVFTVSCRVLTRPTPDFEFTYLVPPSVESKTKPSTLPILTIGELTNSRFPAPIDQLYTSPNADVVVQPQNGRCTLDGELQGTTQLLTTAICSYRGTTSNPTSDYWDDHLLHLVHPNGATYDPTEDVPAPFGTQDFRGILYGVLTQNTQNPRDEVSNSRGIYISSTSDKFTPKLGTIGLHQVQGDTASNQQSKFTPVGIAVNQNTPFKQWELPNYSGALTLNTDLAPAVGPNFPGEQILFFRSNVPSVQGNHPTQEIDCLIPQEWVSHFYQESAPSQSDVALVRYVNPDTGRTIFEAKLHRQGFTTIAATGSNPVVVPPNGYFRFESW

SEQ ID NO: 4144 - protein, 520 aa, Artificial Sequence
  VP1__Norovirus_and/or_Norovirus-like__KU687017
MKMASSDAAPSNDGAAGLVPEINTETLPLEPVAGAAIAAPVTGQNNIIDPWIRNNFVQAPNGEFTVSPRNSPGEILMNLELGPDLNPYLAHLSRMYNGYAGGVEVQVLLAGNAFTAGKILFAAVPPNFPVDMLSPAQITMLPHLIVDVRTLEPIMIPLPDVRNVFYHFNNQPAPRMRLVAVLYTPLRSNGSGDDVFTVSCRVLTRPTPDFEFTYLVPPSVESKTKPFTLPILTIGELTNSRFPAPIDQLYTSPNADVVVQPQNGRCTLDGELQGTTQLLTTAICSYRGTTSNPTSDYWDDHLLHLVHPNGATYDPTEDVPAPFGTQDFRGILYGVLTQDTQNPRDEVSNSRGIYISSTSDKFTPKLGTIGLHQVQGDTASNQQSKFTPVGIAVNQNTPFKQWELPNYSGALTLNTNLAPAVGPNFPGEQILFFRSNVPSVQGNHPTQEIDCLIPQEWVSHFYQESAPSQSDVALVRYVNPDAGRTIFEAKLHRQGFITIAATGSNPVVVPPNGYFRFEAW

SEQ ID NO: 4145 - protein, 520 aa, Artificial Sequence
  VP1__Norovirus_and/or_Norovirus-like__KU687024
MKMASSDAAPSNDGAAGLVPEINTETLPLEPVAGAAIAAPVTGQNNIIDPWIRNNFVQAPNGESTVSPRNSPGEILMNLELGPDLNPYLAHLSRMYNGYAGGVEVQVLLAGNAFTAGKILFAAVPPNFPVDMLSPAQITMLPHLIVDVRTLEPIMIPLPDVRNVFYHFNNQPAPRMRLVAMLYTPLRSNGAGDDVFTVSCRVLTRPTPDFEFTYLVPPSVESKTKPFTLPILTIGELTNSRFPAPIDQLYTSPNTDILVQPQNGRCTLDGELQGTTQLLTTAICSYRGTTSNPTSDYWDDHLLHLVHPNGATYDPTEDVPAPFGTQDFRGILYGVLTQNTQNPRDEVSNSRGIYISSTSDKFTPKLGTIGLHQVQGDTASNQQSKFTPVGIAVNQNTPFKQWELPNYSGALTLNTNLAPAVGPNFPGEQILFFRSNVPSVQGTHPTQEIDCLIPQEWISHFYQESAPSQSDVALVRYVNPDTGRTIFEAKLHRQGFITIAATGSNPVVVPPNGYFRFEAW

SEQ ID NO: 4146 - protein, 520 aa, Artificial Sequence
  VP1__Norovirus_and/or_Norovirus-like__KU687022
MKMASNDAAPSNDGAAGLVPEINTETLPLEPVAGAAIAAPVTGQNNIIDPWIRNNFVQAPNGEFTVSPRNSPGEILMNLELGPDLNPYLAHPSRMYNGYAGGVEVQVLLAGNAFTAGKILFAAVPPNFPVDMLSPTQITMLPHLTVDVRTLEPIMIPLPDVRNVFYHFNNQPAPRMRLVAMLYTPLRSNGSGDDVLTVSCRVLTRPTPDFEFTYLVPPSVESKTKPFTLPILTIGELTNSRFPAPIDQLYTSPNADVVVQPQNGRCTLDGELQGTTQLLTTAICSYRGTTSNPTSDYWDDHLLHLVHPNGATYDPTEDVPAPFGTQDFRGILYGVLTQNTQNPRDEVSNSRGIYISSTSDKFTPKLGTIGLHQVQGDTASNQQSKFTPVGIAVNQNTPFKQWELPNYSGALTLNTNLAPAVGPNFPGEQILFFRSNVPSVQGNHPTQEIDCLIPQEWVSHFYQESAPSQSDVALVRYVNPDTGRTIFEAKLHRQGFITIAATGSNPVVVPPNGYFRFESW

SEQ ID NO: 4147 - protein, 520 aa, Artificial Sequence
  VP1__Norovirus_and/or_Norovirus-like__KU687023
MKMASSDAAPSNDGAAGLVPEINTETLPLEPVAGAAIAAPVTGQNNIIDPWIRNNFVQAPNGEFTVSPRNSPGEILMNLELGPDLNPYLAHLSRMYNGYAGGVEVQVLLAGNAFTAGKILFAAVPPNFPVDMLSPAQITMLPHLIVDVRTLEPIMIPLPDVRNVFYHFNNQPAPRMRLVAMLYTPLRSNGSGDDVFTVSCRVLTRPTPDFEFTYLVPPSVESKTKPFTLPILTIGELTNSRFPAPIDQLYTSPNTDILVQPQNGRCTLDGELQGTTQLLTTAICSYRGTTSNPTSDYWDGHLLHLVHPNGATYDPTEDVPAPFGTQDFRGILYGVLTQNTQNPRDEVSNSRGIYISSTSDKFTPKLGTIGLHQVQGDTASNQQSKFTPVGIAVNQNTPFKQWELPNYSGALTLNTNLAPAVGPNFPGEQILFFRSNVPSVQGTHPTQEIDCLIPQEWISHFYQESAPSQSDVALVRYVNPDTGRTIFEAKLHRQGFIAIAATGSNPVVVPPNGYFRFEAW

SEQ ID NO: 4148 - protein, 520 aa, Artificial Sequence
  VP1__Norovirus_and/or_Norovirus-like__KX764847
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSSNYTMNLASQNWSNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFEAW

SEQ ID NO: 4149 - protein, 520 aa, Artificial Sequence
  VP1__Norovirus_and/or_Norovirus-like__KX764846
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPPIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDAW

SEQ ID NO: 4150 - protein, 520 aa, Artificial Sequence
  VP1__Norovirus_and/or_Norovirus-like__KX764833
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHRATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDAW

SEQ ID NO: 4151 - protein, 520 aa, Artificial Sequence
  VP1__Norovirus_and/or_Norovirus-like__KX764834
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLDTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSW

SEQ ID NO: 4152 - protein, 520 aa, Artificial Sequence
  VP1__Norovirus_and/or_Norovirus-like__KU687027
MKMASNDANPSDGSAANLVPEVNNEVMALEPVVGAAIAALVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGEDVFTVSCRVLTRPSPDFDFIFLVPPTVESRTKPFSVPVLTVEEMTNSRFPIPLEKLFTGPSSAFVVQPQNGRCTTDGVLLGTIQLSPVNICTFRGDVTHITGSRNYTMNLASQNWNDYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTTPGCSGYPNMDLDCLLPQEWVQYFYQEAAPAQSDVALLRFVNPDTGRVLFECKLHKSGYVTVAHTGQHDLVIPPNGYFRFESW

SEQ ID NO: 4153 - protein, 520 aa, Artificial Sequence
  VP1__Norovirus_and/or_Norovirus-like__KX764835
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPPRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKFHKSGYVTVAHTGQHDLVIPPNGYFRFESW

SEQ ID NO: 4154 - protein, 520 aa, Artificial Sequence
  VP1__Norovirus_and/or_Norovirus-like__KX764832
MKMASNDVNPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWALPSYSGRNTHNVHLAPAVAPTFPGEQLLFFRSTMPGCSGYPNMDLDCLLPQEWVQYFYQEAAPAQSDVALLRFVNPNTGRVLFECKLHKSGHVTVAHTGQHDLVIPPNGYFRFDSW

SEQ ID NO: 4155 - protein, 520 aa, Artificial Sequence
  VP1__Norovirus_and/or_Norovirus-like__KU687025
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVVLAGNAFTAGKVIFAAVPPNFPTEDLSPSQVTMFPHIVVDVRQLEPVLIPLPDVRNNFYHYNQSNDPTIKLIAMLYTPLRANNAGEDVFTVSCRVLTRPSPDFDFIFLVPPTVESRTKPFSVPVLTVEEMTNSRFPIPLEKLFTGPSSAFVVQPQNGRCTTDGVLLGTIQLSPVNICTFRGDVTHITGSRNYTMNLASQNWNNYDPTEEIPAPLGTPDFVGKIQGMLTQTTRTDGSTRGHKATVYTGSADFAPKLGRAQFETDTDHDFEANQNTKFTPVGVIQDGSTTHRNEPQQWVLPSYSGRNTPNVHLAPAVAPTFPGEQLLFFRSTTPGCSGYPNMDLDCLLPQEWVQYFYQEAAPAQSDVALLRFVNPDTGRVLFECKLHKSGYVTVAHAGQHDLVIPPNGYFRFEAW

SEQ ID NO: 4156 - protein, 520 aa, Artificial Sequence
  VP1__Norovirus_and/or_Norovirus-like__KU687026
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGEDVFTVSCKVLTRPSPDFDFIFLVPPTVESRTKPFSVPVLTVEEMTNSRFPIPLEKLFTGPSSAFVVQPQNGRCTTDGVLLGTIQLSPVNICTFRGDVTHITGSRNYTMNLASQNWNNCDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTTPGCSGYPNMDLDCLLPQEWVQYFYQEAAPAQSDVALLRFVNPDTGRVLFECKLHKSGYVTVAHTGQHDLVIPPNGYFRFDAW

SEQ ID NO: 4157 - protein, 520 aa, Artificial Sequence
  VP1__Norovirus_and/or_Norovirus-like__KU687028
MKMASNDANPSDGSAANLVPEVNNEVMALEPAVGAAIAAPVAGQQNVIDPWIRNNFVQAPGGEFTVSPRNAPGEILWSAPLGPDLNPYLSHLARMYNGYAGGFEVQVILAGNAFAAGKVIFAAVPPNFPTEGLSPSQVTMFPHIVVDVRQLEPVLIPLPDVRNNFYHYNQSNDPTIKLIAMLYTPLRANNAGEDVFTVSCRVLTRPSPDFDFIFLVPPTVESRTKPFSVPVLTVEEMTNSRFPIPLEKLFTGPSSAFVVQPQNGRCTTDGVLLGTIQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTPNVHLAPAVPPTFPGEQLLFFRSTTPGCSGYPNMDLDCLLPQEWVQYFYQEAAPAQSDVALLRFVNPDTGRVLFECKLHKSGYVTVAHTGQHDLVIPPNGYFRFESW

SEQ ID NO: 4158 - protein, 520 aa, Artificial Sequence
  VP1__Norovirus_and/or_Norovirus-like__KX764831
MKMASSDVNPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTGGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGPTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFEAW

SEQ ID NO: 4159 - protein, 519 aa, Artificial Sequence
  VP1__Norovirus_and/or_Norovirus-like__JN222366
MMMASKDAPTSPDGASGAGQLVPEANTAEQISMDPVAGASTAVATAGQVNMIDPWIFNNFVQAPQGEFTISPNNTPGDILFDLQLGPHLNPFLAHLSQMYNGWVGNMRVRILLAGNAFTAGKIIICCVPPGFDARILTIAQATLFPHLIADVRTLEPVELPLEDVRNVLYHNSSQPQPTMRLVAMLYTPLRTGGGSGGTDAFVVAGRVLTCPAPDFSFLFLVPPSVEQKTRVFSVPNIPLKDLSNSRVPVPIQGMFMSPDVNQSVQFQNGRCQIDGQLQGTTPVSLSQLCKIRGKTSSNARVLNLSEVDGTPFIPLESPAPVGFPDLGGCDWHVNFTFQAQNQDPSQSVTFATNDASFVPYLGSISPHNGGDFHAGDIIGSLGWISAPSDNSQLNVWTIPKYGSSLPDVTHLAPAVFPPGFGEVILYFYSTFPGSGQPSQLQVPCLLPQEFITHFCNEQAPIAGEAALLHYVDPDTGRNLGEFKLYPDGFMTCVPNSVSSGPQTLPINGVFVFVSWVSR

SEQ ID NO: 4160 - protein, 518 aa, Artificial Sequence
  VP1__Norovirus_and/or_Norovirus-like__KM386679
MKMASNDATPSNDGAAGLVPESNNEAMALEPVVGASLAAPVTGQTNIIDPWIRTNFVQAPNGEFTVSPRNSPGEILVNLELGPELNPYLAHLARMYNGYAGGMEVQVMLAGNAFTAGKIIFAAVPPYFPVENLSPSQITMFPHVIIDVRTLEPVLLPMPDVRSTLFHFNQKDEPKMRLVAMLYTPLRSNGSGDDVFTVSCRILTRPSPEFDFTYLVPPTVESKTKPFTLPVLTLGELSNSRFPLSIDEMVTSPNESIVVQPQNGRVTLDGELLGTTQLQACNICSIRGKVTGQVPNEQHMWNLEITNLNGTQFDPTDDVPAPLGVPDFAGEVFGVLSQRNRGESNPANRAHDAVVATYSDKYTPKLGLVQIGTWNTNDVENQPTKFTPIGLNEVANGHRFEQWTLPRYSGALTLNMNLAPAVAPLFPGERLLFFRSYVPLKGGFGNPAIDCLVPQEWVQHFYQESAPSLGDVALVRYVNPDTGRVLFEAKLHKGGFLTVSSTSTGPVVVPANGYFRFD

SEQ ID NO: 4161 - protein, 516 aa, Artificial Sequence
  VP1__Norovirus_and/or_Norovirus-like__AY549156
MKMTDRDTVDSAPALGQVLPPEVEASVPVEPTAGAPVAAPTAGQVNPIDPWIFANFVQAPQGEFTISPNNNPGEILFELELGPDLNPYLAHLRRMYNGWTGSMRVRVLLAGNAFSAGKVVVFCVPPGFDTSYLTPSQATQFPHVLIDVRAPEPVEMPLEDVRNILFHQGPDSRMRLMGMLYTPLRANSGADPFVVTGRVLTCPSPNFSFFFLVPPTVEEREPPFTLPNLPVNNLSHSRVMEPIAQMMSSRNFPASVQFQNGRCTLSGDLLGTTPSSPADLGAFVGLRAEPGSRVVELSQPNQEDFHAGSAPAPFGFPDFSDCSVTFVVASATTVGERTVNTRSLQNFTPALGHITFDEEAPADLFRAHFRNLWEPTEHSFWRIPDYRADVLGSDFAPSVSAPGVGETLLFFMCNVPRLNGANPNPCPCLLPQEWITHFVSERAALQSDVALLNYVNPNTGRVLFEAKLYANGFLTVNLGAPDQATLPVDGIFKFVSWVSSYYQLRPVGNASAGRRL

SEQ ID NO: 4162 - protein, 516 aa, Artificial Sequence
  VP1__Norovirus_and/or_Norovirus-like__AY549163
MKMTDRDTIDSAPALGQVLPPEVEASVPVEPTAGAPVAAPTAGQVNPIDPWIFANFVQAPQGEFTISPNNNPGEILFELELGPDLNPYLAHLRRMYNGWTGSMRVRVLLAGNAFSAGKVVVFCVPPGFDTSYLTPSQATQFPHVLIDVRAPEPVEMPLEDVRNILFHQGPDSRMRLMGMLYTPLRANYGADPFVVTGRVLTCPSPNFSFFFLVPPTVEERETPFTLPNLPVNNLSHSRVMEPIAQMMSSRNFPASVQFQNGRCTLSGDLLGTTPSSPADLGAFVGLRAEPGSRVVELSQPNQEDFHAGSAPAPFGFPDFSDCSVTFVVASATTVGERTVNTRSLQNFTPALGHITFDEEAPADLFRAHFRNLWEPTEHSFWRIPDYRADVLGSDFAPSVSAPGVGETLLFFMCNVPRLNGANPNPCPCLLPQEWITHFVSERAALQSDVALLNYVNPNTGRVLFEAKLYANGFLTVNLGASDQAILPVDGIFKFVSWVSFYYQLRPVGNASVGRRL

SEQ ID NO: 4163 - protein, 516 aa, Artificial Sequence
  VP1__Norovirus_and/or_Norovirus-like__AY549159
MKMTDRDTVDSAPALGQVLPPEVEASVPVEPTAGAPVAAPTAGQVNPIDPWIFANFVQAPQGEFTISPNNNPGEILFELELGPDLNPYLAHLRRMYNGWTGSMRVRVLLAGNAFSAGKVVVFCVPPGFDTSYLTPSQATQFPHVLIDVRAPEPVEMPLEDVRNILFHQGPDSRMRLMGMLYTPLRANSGADPFVVTGRVLTCPSPNFSFFFLVPPTVEERETPFTLPNLPVNNLSHSRVMEPIAQMMSSRNFPASVQFQNGRCTLSGDLLGTTPSSPADLGAFVGLRAEPGSRVVELSQPNQEDFHAGSAPAPFGFPDFSDCSVTFVVASATTVGERTVNARSLQNFTPALGHITFDEEAPADLFRAHLRNLWEPTEHSFWRIPDYRADVLGSDFAPSVSAPGVGETLLFFMCNVPRLNGANPNPCPCLLPQEWITHFVSERAALQSDVALLNYVSPNTGRVLFEAKLYANGFLTVNLGASDQATLPVDGIFKFVSWVSFYYQLRPVGNASVGRRL

SEQ ID NO: 4164 - protein, 516 aa, Artificial Sequence
  VP1__Norovirus_and/or_Norovirus-like__AY549166
MKMTDRDTVDSAPALGQVLPPEVEASVPVEPTAGAPVAAPTAGQVNPIDPWIFANFVQAPQGEFTISPNNNPGEILFELELGPDLNPYLAHLRRMYNGWTGSMRVRVLLAGNAFSAGKVVVFCVPPGFDTSYLTPSQATQFPHVLIDVRAPEPVEMPLEDVRNILFHQGPDSRMRLMGMLYTPLRANSGADPFVVTGRVLTCPSPNFSFFFLVPPTVEERETPFTLPNLPVNNLSHSRVMEPIAQMMSSRNFPASVQFQNGRCTLSGDLLGTTPSSPADLGAFVGLRAEPGSRVVELSQPNQEDFHAGSAPAPFGFPDFSDCSVTFVVASATTVGERTVNTRSLQNFTPALGHITFDEEAPADLFRAHFRNLWEPTEHSFWRIPDYRADVLGSDFAPSVSAPGVGETLLFFMCNVPRLNGANPNPCPCLLPQEWITHFVSERAALQSDVALLNYVNPNTGRVLLEAKLCANGFLTVNLGASDQATLPVDGIFKFVSWVSFYYQLRPVGNASVGRRL

SEQ ID NO: 4165 - protein, 516 aa, Artificial Sequence
  VP1__Norovirus_and/or_Norovirus-like__AF320113
MKMTDRDIIDSAPALGQVLPPEVEASVPVEPTAGAPVAAPTAGQVNPIDPWIFANFVQAPQGEFTISPNNNPGEILFELELGPDLNPYLAHLRRMYNGWTGSMRVRVLLAGNAFSAGKVVVFCVPPGFDTSYLTPSQATQFPHVLIDVRAPEPVEMPLEDVRNILFHQGPDSRMRLMGMLYTPLRANSGADPFVVTGRVLPCPSPNFSFFFLVPPTVEEREPPFTLPNLPVNNLSHSRVMEPIAQMMSSRTFPASVQFQNGRCTLSGDLLGTTPSSPSDLGAFVGLIAEPGSRVVELFQPNQEDFHAGSAPAPLGFPDFSDCSLTFVVASATTVGERTVNARSLQNFTPALGHITFDEEAPADLFRAHLRNLWDPTEHSFWRIPDYRADVLGSELAPSVSAPGVGETLLFFTCNVPRLNGANPNPCPCLLPQEWITHFVSERAALQSDVALLNYVNPNTGRVLFEAKLYVNGFLTVNLGASDQATLPVDGIFKFVSWVSFYYQLRPVGNASVGRRL

SEQ ID NO: 4166 - protein, 516 aa, Artificial Sequence
  VP1__Norovirus_and/or_Norovirus-like__AY549153
MKMTDRDTVDSAPALGQVLPPEVEASVPVEPTAGAPVAAPTAGQVNPIDPWIFANFVQAPQGEFTISPNNNPGEILFELELGPDLNPYLAHLRRMYNGWTGSMRVRVLLAGNAFSAGKVVVFCVPPGFDTSYLTPSQATQFPHVLIDVRAPEPVEMPLEDVRNILFHQGPDSRMRLMGMLYTPLRANSGADPFVVTGRVLTCPSPNFSFFFLVPPTVEEREPPFTLPNLPVNNLSHSRVMEPIAQMMSSRSSPASIQFQNGRCTLSGDLLGTTPSSPADLGAFVGLRAEPGSHVVELSQPNQEDFHAGSAPAPFGFPDFSDCSVTFVVASATIVEQRTVNARSLQNFTPALGHITFDEEAPADLFRARFRNVWDPTEHSFWRIPDYRADVLGSDFAPSVSAPGVGETLLFFMCNVPHSNGANPNPCPCLLPQEWITHFVSERAALQGDVALLNYINPNTGRVSFEAKLYANGFLTVNLGASDRTTLPVDGIFKFVSWVSFYYQLRPVGNASVGRRL

SEQ ID NO: 4167 - protein, 516 aa, Artificial Sequence
  VP1__Norovirus_and/or_Norovirus-like__AY549157
MKMTDRDTVDSAPALGQVLPPEVEASVPVEPTAGAPVAAPTAGQVNPIDPWIFANFVQAPQGEFTISPNNNPGEILFELELGPDLNPYLAHLRRMYNGWTGSMRVRVLLAGNAFSAGKVVVFCVPPGFDTSYLTPSQATQFPHVLIDVRAPEPVEMPLEDVRNILFHQGPDSRMRLMGMLYTPLRANSGADPFVVTGRVLTCPSPNFSFFFLVPPTVEEREPPFTLPNLPVNNLSHSRVMEPIAQMMSSRNFPASVQFQNGRRTLSGDLLGTTPSSPADLGAFVGLRAEPGSRVVELSQPNQEDFHAGSAPAPFGFPDFSDCSVTFVVASATTVGERTVNTRSLQNFTPALGHITFDEEAPADLFRAHFRNLWEPTEHSFWRIPDYRADVLGSDFAPSVSAPGVGETLLFFMCNVPRLNGANPNPCPCLLPQEWITHFVSERAALQSDVALLNYVNPNTGRVLFEAKLYANGFLTVNLGASDQATLPVDGIFKFVSWVSFYYQLRPVGNASVGRRL

SEQ ID NO: 4168 - protein, 516 aa, Artificial Sequence
  VP1__Norovirus_and/or_Norovirus-like__AY549158
MKMTDRDAVDSAPALGQVLPPEVEASVPVEPTAGAPVAAPTAGQVNPIDPWIFANFVQAPQGEFTISPNNNPGEILFELELGPDLNPYLAHLRRMYNGWTGSMRVRVLLAGNAFSAGKVVVFCVPPGFDTSYLTPSQATQFPHVLIDVRAPEPVEMPLEDVRNILFHQGPDSRMRLMGMLYTPLRANSGADPFVVTGRVLTCPSPNFSFFFLVPPTVEEREPPFTLPNLPVNNPSHSRVMEPIAQMMSSRNFPASVQFQNGRCTLSGDLLGTTPSSPADLGAFVGLRAEPGSRVVELSQPNQEDFHAGSAPAPFGFPDFSDCSVTFVVASATTVGERTVNTRSLQNFTPALGHITFDEEAPADLFRAHFRNLWEPTEHSFWRIPDYRADVLGSDFAPSVSAPGVGETLLFFMCNVPRLNGANPNPCPCLLPQEWITHFVSERAALQSDVALLNYVNPNTGRVLFEAKLYANGSLTVNLGASDQATLPVDGIFKFVSWVSFYYQLRPVGNASVGRRL

SEQ ID NO: 4169 - protein, 516 aa, Artificial Sequence
  VP1__Norovirus_and/or_Norovirus-like__AY549165
MKMTDRDTVDSAPALGQVLPPEVEASVPVEPTAGAPVAAPTAGQVNPIDPWIFANFVQAPQGEFTISPNNNPGEILFELELGPDLNPYLAHLRRMYNGWTGSMRVRVLLAGNAFSAGKVVVFCVPPGFDASYLTPSQATQFPHVLIDVRAPEPVEMPLEDVRNILFHQGPDSRMRLMGMLYTPLRANSGADPFVVTGRVLTCPSPNFSFFFLGPPTVEEREPLFTLPNLPVNNLSHSRVMEPIAQMMSSRSFPASVQFQNGRCTLSGDLLGTTPSSPADLGAFVGLRAEPGSHVVELSQPNQEDFHAGSAPAPFGFPDFSGCSVTFVVASATIVEQRTVNTRSLQNFTPALGHITFDEEAPADLFRARFRNVWDPTEHSFWRIPDYRADVLGSDFAPSVSAPGGGETLLFFMCNVPHSNGANPNPCPCLLPQEWITHFVSERAALQGDVALLNYINPNTGRVLFEAKLYANGFLTVNLGASDQAALPVDGIFKFVSWVSFYYQLRPVGNASVGRRL

SEQ ID NO: 4170 - protein, 516 aa, Artificial Sequence
  VP1__Norovirus_and/or_Norovirus-like__AY549167
MKMTDRDTVDSAPALGQVLPPEVEASVPVEPTAGAPVAAPTAGQVNPIDPWIFANFVQAPQGEFTISPNNNPGEILFELELGPDLNPYLAHLRRMYNGWTGSMRVRVLLAGNAFSAGKVVVFCVPPGFDTSYLTPSQATQFPHVLIDVRAPEPVEMPLEDVRNILFHQGPDSRMRLMGMLYTPLRANSGADPFVVTGRVLTCPSPNFSFFFLVPPTVEEREPLFTLPNLPVNNLSHSRVMEPIAQMMSSRGFPASVQFQNGRCTLSGDLLGTTPSSPADLGAFVGLRAEPGSHVVELSQPNQEDFHAGSAPAPFGFPDFSDCSVTFVVASATIVEQRTVNARSLQNFTPALGHITFDEEAPADLFRARFRNVWDPTEHSFWRIPDYRADVLGSDFAPSVSAPGVGETLLFFMCNVPHSSGANPNPCPCLLPQEWITHFVSERAALQGDVALLNYINPNTGRVLFEAKLYANGFLTVNLGASDQATLPVDGIFKFVSWVSFYYQLRPVGNASVGRRL

SEQ ID NO: 4171 - protein, 516 aa, Artificial Sequence
  VP1__Norovirus_and/or_Norovirus-like__AY549154
MKMTDRDTVDPAPALGQVLPPEVEASVPVEPTAGAPVAAPTAGQVNPIDPWIFANFVQAPQGEFTISPNNNPGEILFELELGPDLNPYLAHLRHMYNGWTGSMRVRVLLAGNAFSAGKVVVFCVPPGFDTSYLTPSQATQFPHVLIDVRAPEPVEMPLEDVRNILFHQGPDSRMRLMGMLYTPLRANSSADPFVVTGRVLTCPNPNFSFFFLVPPTVEEREPPFTLPNLPVNNLSHSRVMEPIAQMMSSRNFPASVQFQNGRCTLSGDLLGTTPSSPADLGAFVGLRAEPGSRVVELSQPNQEDFHAGSAPAPFGFPDFSDCSVTFVVASATTVGERTVNTRSLQNFTPALGHITFDEEAPADLFRAHFRNLWEPTEHSFWRIPDYRADVLGSDFAPSVSAPGVGETLLFFMCNVPRLNGANPNPCPCLLPQEWITHFVSERAALQSDVALLNYVNPNTGRVLFEAKLYANGFLTVNLGASDQATLPVDGIFKFVSWVSFYYQLRPVGNASVGRRL

SEQ ID NO: 4172 - protein, 516 aa, Artificial Sequence
  VP1__Norovirus_and/or_Norovirus-like__AY549155
MKMTDRDTVDSAPALGQVLPPEVEASVPVEPTAGAPVAAPTAGQVNPIDPWIFANFVQAPQGEFTISPNNNPGEILFELELGPDLNPYLAHLRRVYNGWTGSMRVRVLLAGNAFSAGKVVVFCVPPGFDTSYLTPSQATQFPHVLIDVRAPEPVEMPLEDVRNILFHQGPDSRMKLMGMLYTPLRANSSANPFVVTGRVLTCPSPNFSFFFLVPPTVEEREPPFTLPNLPVNNLSHSQVMEPIAQMMSSRNFPASVQFQNGRCTLSGDLLGTTPSSPADLGAFVGLRAEPGSRVVELSQPNQEDFHAGSAPAPFGFPDFSDCSVTFVVASATTVGERTVNARTLQNFTPALGHITFDEEAPADLFRAHFRNLWEPTEHSFWRIPDYRADVLGSDFAPSVSAPGVGETLLFFMCNVPRLNGANPNPCPCLLPQEWITHFVSERAALQSDVALLNYVNPNTGRVLFEAKLYANGFLTVNLGASDQATLPVDGIFKFVSWVSFYYQLRPVGNASVGRRL

SEQ ID NO: 4173 - protein, 516 aa, Artificial Sequence
  VP1__Norovirus_and/or_Norovirus-like__AF320625
MKMTDRDIIDSAPALGQVLPPEVEASVPVEPTAGAPVAAPTAGQVNPIDPWIFANFVQAPQGVFTISPNNNPGEILFELELGPDLNPYLAHLRRMYNGWTGSMRVRVLLAGNAFSAGKVVVFCVPPGFDTSYLTPSQATQFPHVLIDVRAPEPVEMPLEDVRNILFHQGPDSRMRLMGMLYTPLRANSGADPFVVTGRVLTCPSPNFSFFFLVPPTVEEREPSFTLPNLPVNNLSHSRVMEPIAQMMSSRTFPASVQFQNGRCTLSGDLLGTTPSSPSDLGAFVGLIAEPGSRIVELSQPNQEDFHAGSAPAPFGFPDFSDCSLTFVVASATTVGERTVNARSLQNFTPALGHITFDEEAPADLFRAHLRNLWDPTEHSFWRIPDYRADVLGSEFAPSVSAPGVGETLLFFMCNVPRLNGANPNPCPCLLPQEWITHFVSERAALQSDVALLNYVNPNTGRVLFEAKLYANGFLTVNLGASDQATLPVDGIFKFVSWVSFYYQLRPVGNASVGRRL

SEQ ID NO: 4174 - protein, 516 aa, Artificial Sequence
  VP1__Norovirus_and/or_Norovirus-like__AY274820
MKMTDRDTVDSAPALGQVLPPEVEASVPVEPTAGAPVAAPTAGQVNPIDPWIFANFVQAPHGEFTISPNNNPGEVLFELKLGPDLNPYLAHLRRMYNGWTGSMRVRVLLAGNAFSAGKVVVFCVPPGFDTSYLTPSQATQFPHVLIDVRAPKPVEMPLEDVRNILFHQGPDSRMRLMGMLYTPLRANSGADPFVVTGRVLTCPSPNFSFFFLVPPTVEEREPPFTLPNLPVNNLSHSRVMEPIAQMMSSRNFPASVQFQNGRCTLSGDLLGTTPSSPADLGAFVGLRAEPGSRVVELSQPNQEDFHAGSAPAPFGFPDFSECSVTFMVASATTVGERTVNTRSLQNFTPALGHITFDEEAPADLFRARFRNLWEPTEHSFWRIPDYRADVLGSEFAPSVSAPGVGETLLFFMCNVPRLNGANPNPCPCLLPQEWITHFVSERAALQSDVALLNYVNPNTGRVLFEAKLYANGFLTVNLGASDQASLPVDGIFKFVSWVSFYYQLRPVGNASVGRRL

SEQ ID NO: 4175 - protein, 516 aa, Artificial Sequence
  VP1__Norovirus_and/or_Norovirus-like__AF542083
MKMTDRDTVDSAPALGQVLPPEVEASVPVEPTAGAPVAAPTAGQVNPIDPWIFANFVQAPQGEFTISPNNNPGEVLFELELGPDLNPYLAHLRRMYNGWTGSMRVRVLLAGNAFSAGKVVVFCVPPGFDTSYLTPSQATQFPHVLIDVRAPEPVEMPLEDVRNILFHQGPDSRMRLMGMLYTPLRANSGADPFVVTGRVLTCPSPNFSFFFLVPPTVEEREPPFTLPNLPVNNLSHSRVMEPIAQMMSSRNFPASVQFQNGRCTLSGDLLGTTPSSPADLGAFVGLRAEPGSRVVELSQPNQEDFHVGSAPAPLGFPDFSDCSVTFVVASATTVGERTVNTRSLQNFTPALGHITFDEEAPADLFRAHFRNLWEPTEHSFWRIPDYRADVLGSDFAPSVSAPGVGETLLFFMCNVPRLNGANPNPCPCLLPQEWITHFVSERAALQSDVALLNYVNPNTGRVLFEANLYANGFLTVNLGASDQATLPVDGIFKFVSWVSFYYQLRPVGNASVGRRL

SEQ ID NO: 4176 - protein, 516 aa, Artificial Sequence
  VP1__Norovirus_and/or_Norovirus-like__EU794907
MKMTDRDVTDSAPALGQVLPPEVEASVPVEPTAGAPVAAPTAGQVNPIDPWIFANFVQAPQGEFTISPNNNPGEILFELELGPDLNPYLAHLRRMYNGWTGSMRVRVLLAGNAFSAGKVVVFCVPPGFDTSYLTPSQATQFPHVLIDVRAPEPVEMPLEDVRNILFHQGPDSRMRLMGMLYTPLRANSGADPFVVTGRVLTCPSPNFSFFFLVPPTVEEREPPFTLPNLPVNNLSHSRVMEPIAQMMSSRNFPASVQFQNGRCTLSGDLLGTTPSSPSDLGAFVGLIAEPGSRVVELSQPNQEDFHAGSAPAPFGFPDFSDCSLTFVVASATTVGERTVNARSPQNFTPALGHITFDEEAPADLFRAHLRNLWDPTEHSFWRIPDYRADVLGSEFAPSVSAPGVGETLLFFMCNVPRLNGANPNPCPCLLPQEWITHFVSERAALQSDVALLNYVNPNTGRVLFEAKLYANGFLTVNLGASDQATLPVDGIFKFVSWVSFYYQLRPVGNASVGRRL

SEQ ID NO: 4177 - protein, 516 aa, Artificial Sequence
  VP1__Norovirus_and/or_Norovirus-like__AY126474
MKMTDRDTIDSAPALGQVLPPEVEASVPVEPTAGAPVAAPTAGQVNPIDPWIFANFVQAPQGEFTISPNNNPGEILFELELGPDLNPYLAHLRRMYNGWTGSMRVRVLLAGNAFSAGKVVVFCVPPGFDTSYLTPSQATQFPHVLIDVRAPEPVEMPLEDVRNILFHQGPDSRMRLMGMLYTPLRANSGADPFVVTGRVLTCPSPNFSFFFLVPPTVEEREPPFTLPNLPVNNLSHSRVMEPIAQMMSSRNFPASVQFQNGRCTLSGDLLGTTPSSPADLGAFVGLIAEPGSRVVELSQPNQEDFHAGSAPAPFGFPDFSECSLTFVVASATTVGERTVNTRSLQNFTPALGHITFDEEAPADLFRAHLRNLWDPTEHSFWRIPDYRADVLGSEFAPSVSAPGVGETLLFFMCNVPRLNGANPGLCPCLLPQEWITHFVSERAALQSDVALLNYVNPNTGRVLFECKLYANGFLTVNLGASDQATLPVDGIFKFVSWVSFYYQLRPVGNASVGRRL

SEQ ID NO: 4178 - protein, 516 aa, Artificial Sequence
  VP1__Norovirus_and/or_Norovirus-like__JX145650
MKMTDRDIVDSAPALGQVLPPEVEASVPVEPTAGAPVAASTAGRVNPIDPWIFANFVQAPQGEFTISPNNNPGEILFELELGPDLNPYLAHLRRMYNGWTGSMRVRVLLAGNAFSAGKVVVFCVPPGFDTSYLTPSQATQFPHVLIDVRAPEPVDMPLEDVRNILFHQGPDSRMRLMGMLYTPLRANSGADPFVVTGRVLTCPSPNFSFFFLVPPTVEEREPPFTLPNLPVNSLSHSRVMEPIAQMMSSRSFPASVQFQNGRCTLSGDLLGTTPSSPADLGAFVGLIAEPGSRVVELSQPNQEDFHAGSAPAPFGFPDFSECSVTFVVASATTVGERTVNARNPQNFTPALGHITFDEEAPADLFRARFRNLWEPTEHSFWRIPDYRADVLGSDFAPSVSAPGVGETLLFFMCNVPRLNGANPNPCPCLLPQEWITHFVSERAALQSDVALLNYVNPNTGRVLFEAKLYANGFLTVNLGASDQAILPVDGIFKFVSWVSFYYQLRPVGNISVGRRL

SEQ ID NO: 4179 - protein, 515 aa, Artificial Sequence
  VP1__Norovirus_and/or_Norovirus-like__AY549161
MKMTDRDTTDSAPALGQVLPPEVEASVPVEPTAGAPVAAATAGQVNPIDPWIFANFVQAPQGEFTISPNNNPGEILFELELGPDLNPYLAHLRRMYNGWTGSMRVRVLLAGNAFSAGKVVVFCVPPGFDASYLTPSQATQFPHVLIDVRAPEPVEMPLEDVRNILFHQGPDSRMKLMGMLYTPLRANSGADPFVVTGRVLTCPSPNFSFFFLVPPTVEEREAPFTLPNLPVNSLSHSRYVGPIMQMMSSRTFPASVQFQNGRCTLSGDLLGTTPSSSADLGAFVGLIAEAGSRVVELSQPNQEDFHAGSAPAPLGFPDFSDCSLTFVVASLTTVGERTVNARSLQNFTPALGHVTFDEEAPADLFRARLRNLWDPTEHSVWRIPDYRADVLGSEFAPSVSAPGVGETLLFFMCNVPHQTGANPNPCPCLLPQEWITHFVSERAALQSEVALLNYVNPNTGRVLFECKLYANGFLTVNLGASDQVSLPVDGIFKFVSWVSFYYQLRPVGNTGVGRR

SEQ ID NO: 4180 - protein, 515 aa, Artificial Sequence
  VP1__Norovirus_and/or_Norovirus-like__AY549164
MKMTDRDAVDSAPALGQVLPPEVEASVPVEPTAGAPVAAPTAGQVNPIDPWIFANFVQAPQGEFTISPNNNPGEILFELELGPDLNPYLAHLRRMYNGWTGSMRVRVLLAGNAFSAGKVVVFCVPPGFDTSYLTPSQATQFPHVLIDVRAPEPVEMPLEDVRNILFHQGPDSRMRLMGMLYTPLRANSGADPFVVTGRVLTCPSPNFSFFFLGPPTVEEREPLFTLPNLPVNNLSHSRVMEPIAQMMSSRSFPASVQFQNGRCTLSGDLLGTTPSSPADLGAFVGLRAEPGSRVVELSQPNQEDFHAGSAPAPFGFPDFSDCSVTFVVANATTVQECTVNTRNPQNFTPALGHITFDEEAPADLFRARFRNLWDPTEHSFWRIPDYRAEVLGSDFAPSVSAPGVGETLLFFMCNVPRSNGANPNPCPCLLPQEWITHFVSERAALQSDVALLNYVNPNTGRVLFEAKLYANGFLTVNLGASDQATLPVDGIFKFVSWVSFYYQLRPVGNTSVGRR

SEQ ID NO: 4181 - protein, 515 aa, Artificial Sequence
  VP1__Norovirus_and/or_Norovirus-like__AY126476
MKMTDRDTVDSAPALGQVLPPEVEASVPVEPTAGAPVAAPTAGQVNPIDPWIFANFVQAPQGEFTISPNNNPGEILFELELGPDLNPYLAHLRRMYNGWTGSMRVRVLLAGNAFSAGKVVVFCVPPGFDTSYLTPSQATQFPHVLIDVRAPEPVEMPLEDVRNILFHQGPDSRMRLMGMLYTPLRANSGADPFVVTGRVLTCPSPNFSFFFLVPPTVEEREPPFTLPNLPVNNLSHSRVMEPIAQMMSSRSFPASVQFQNGRCTLSGDLLGTTPSSPADLGAFVGLRAEPGSRVVELSQPNQEDFHAGSAPAPFGFPDFSDCSVTFVVASATTVQECTVNTRNLQNFTPALGHITFDEEAPADLFRARFRNLWDPTEHSLWRIPDYRAEVLGSDFAPSVSAPGVGETLLFFMCNVPRSNGANPNPCPCLLPQEWITHFVSERAALQSDVALLNYVNPNTGRVLFEAKLYASGFLTVNLGASDQATLPVDGIFKFVSWVSFYYQLRPVGNTSVGRR

SEQ ID NO: 4182 - protein, 515 aa, Artificial Sequence
  VP1__Norovirus_and/or_Norovirus-like__EU794905
MKMTDRDTIDSAPALGQVLPPEVEASVPVEPTAGAPVAAPTAGQVNPIDPWIFANFVQAPQGEFTISPNNNPGEILFELELGPDLNPYLAHLRRMYNGWTGSMRVRVLLAGNAFSAGKVVVFCVPPGFDTSYLTPSQATQFPHVLIDVRAPEPVEMPLEDVRNILFHQGPDSRMRLMGMLYTPLRANSGADPFVVTGRVLTCPSPNFSFFFLVPPTVEERETPFTLPNLPVNSLSHSRAMEPIAQMMSSRNFPASVQFQNGRCTLSGDLLGTTPSSPADVGTFVGLIAEPGSHVVELSQPNQEDFHAGSAPAPFGFPDFSDCSLTFVVASASTVGERTVNTRSPQNFTPALGHITFDEEAPADLFRAHLRNLWDPTEHSFWRIPDYRADVLGGEFAPSVSAPGVGETLLFFMCNVPRSNGANPNPCPCLLPQEWITHFVSERAALQSDVALLNYINPNTGRVLFECKLYANGFLTVNLGASDQATLPVDGIFKFVSWVSFYYQLRPVGNIGVGRR

SEQ ID NO: 4183 - protein, 515 aa, Artificial Sequence
  VP1__Norovirus_and/or_Norovirus-like__EU794906
MKMTDRDTIDSAPALGQVLPPEVEASVPVEPTAGAPVAAPTAGQVNPIDPWIFANFVQAPQGEFTISPNNNPGEILFELELGPDLNPYLAHLRRMYNGWTGSMRVRVLLAGNAFSAGKVVVFCVPPGFDTSYLTPSQATQFPHVLIDVRAPEPVEMPLEDVRNILFHQGPDSRMRLMGMLYTPLRANSGADPFVVTGRVLTCPSPNFSFFFLVPPTVEERETPFTLPNLPVNSLSHSRVMEPIAQMMSSRNFPASVQFQNGRCTLSGDLLGTTPSSPADLGTFVGLIAEPGSHVAELSQPNQEDFHAGSAPAPFGFPDFSECSLTFVVASASTVGERTVNTRSLQNFTPALGHITFDEEAPADLFRAHLRNLWDPTEHSFWRIPDYRADVLGGEFAPSVSAPGVGETLLFFMCNVPRLNGANPNPCPCLLPQEWITHFVSERAALQSDVALLNYINPNTGRVLFECKLYVNGFLTVNLGASDQATLPVDGIFKFVSWVSFYYQLRPVGNIGVGRR

SEQ ID NO: 4184 - protein, 515 aa, Artificial Sequence
  VP1__Norovirus_and/or_Norovirus-like__AY126475
MKMTDRDTADPAPALGQVLPPEVEASVPVEPTAGAPVAAPTAGQVNPIDPWIFANFVQAPQGEFTISPNNNPGEILFELELGPDLNPYLAHLRRMYNGWTGSMRVRVLLAGNAFSAGKVVVFCVPPGFDTSYLTPSQATQFPHVLIDVRVPEPVEMPLEDVRNILFHQGPDSRMRLMGMLYTPLRANSGADPFVVTGRVLTCPSPNFSFFFLVPPTVEEREPPFTLPNLPVNNLSHSRVMEPIAQMMSSRSFPASVQFQNGRCTLSGDLLGTTPSSPADLGAFVGLIAEPGSRVVELFQPNQEDFHAGSAPAPFGFPDFSECSVTFVVSSATTVGERTVNARNQQNFTPALGHITFDEEAPADLFRACFRNLWEPTEHSFWRIPDYRADVLGSDFAPSVSAPGVGETLLFFMCNVPRLNGVNPGPCPCLLPQEWITHFVSERAALQSDVALLNYVNPNTGRVLFEAKLYANGFLTVNLGASDQATLPVDGIFKFVSWVSFYYQLRPVGNTSVGRR

SEQ ID NO: 4185 - protein, 515 aa, Artificial Sequence
  VP1__Norovirus_and/or_Norovirus-like__AF542084
MKMTDRDTVDSAPALGQVLPPEVEASVPVEPTAGAPVAAPTAGQVNPIDPWIFANFVQAPQGEFTISPNNNPGEILFELELGPDLNPYLAHLRRMYNGWTGSMRVRVLLAGNAFSAGKVVVFCVPPGFDTSYLTPSQATQFPHVLIDVRAPEPVEMPLEDVRNILFHQGPDSRMRLMGMLYTPLRANSGADPFVVTGRVLTCPSPNFSFFFLVPPTVEEREPLFTLPNLPVNNLSHSRVMEPIAQMMSSRNFPASVQFQNGRCTLSGDLLGTTPSSPADLGAFVGLRAEPGSRVVELSQPNQEDFHAGSAPAPLGFPDFSDCSVTFVVANATTVQECTVNTRNPQNFTPALGHITFDEEAPADLFRAHFRNLWDPTEHSFWRIPDYRAEVLGSDFAPSVSAPGVGETLLFFMCNVPRSNGANPNPCPCLLPQEWITHFVSERAALQSDVALLNYVNPNTGRVLFEAKLYANGFLTVNLGASDQATLPVDGIFKFVSWVSFYYQLRPVGNTSVGRR

SEQ ID NO: 4186 - protein, 511 aa, Artificial Sequence
  VP1__Norovirus_and/or_Norovirus-like__KC695807
MALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGAPDFVGKIQGMLTQTTRADGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRR

SEQ ID NO: 4187 - protein, 268 aa, Artificial Sequence
  VP2_capsid_protein__Norovirus__AGL98415
MAGAFFAGLASDVLGSGLGSLINAGAGAINQKVEFENNRKLQQASFQFSSNLQQASFQHDKEMLQAQIDATHKLQQGLMQIKQAVLLEGGFSAADAARGAINAPMTKALDWSGTRYWAPEARVTTYNAGHFSPSQPSRAPSGRINSGTPTPARNSLNSPATSSVATSVHSNQTASTRIGSSAGSGTSVSSLPSTSRTRNWVEDQNRSVSPFMRGALNTSFVTPPSSRSSNQSTVSTVPKEILDSWTGAFNTRRQPLFAHIRRRGESRV

SEQ ID NO: 4188 - protein, 263 aa, Artificial Sequence
  VP2_capsid_protein__Norovirus__AGL98417
MAGAFFAGLASDVLGTGLGSLIGAGAGAINQKVEYENNRKLQQASFQFSSDLQQASFQHDKDMLQAQIKATQKLQHDLMRVKQAVLLEGGFSPTDAARGAINAPMTKVLDWSGTRYWAPGARVTTSNAGQFSFSQPIREPSGRTAPARSPANRASSVSAPSSTLSNQTTSTRLGTSAGSGASVSGSSSASRVRSWVEGQNRSLSPFMDGALHTSFVTPPSSKSSSQGTVSTVPKEVLDSWTGAFNTHRQPLFAHVRRQGESRV

SEQ ID NO: 4189 - protein, 215 aa, Artificial Sequence
  capsid_protein_VP2__Norovirus__AFI08232
MAQAVLGAIAATAAGSAVGAGIQAGTEAALQHQRFQQDLTLQSNTFKHDKEMLAMQVEASTSLLQNSLNTRYNLLTQAGLTSADAARAVAGAPVTRVVDWNGTRIAAPLSTATTLRSGGFMSIPVMYRGAKTEQQKLTGFSNPNYETGSSVSRTSQWVSSQNSMRSSVAPFHPDALRTTWVTPPGSSSTSTVSSASSIPRFFNTERLPLFANNKR

SEQ ID NO: 4190 - protein, 268 aa, Artificial Sequence
  capsid_protein_VP2__Norovirus__AFI08235
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKALDWSGTRYWAPDARTTTYNAGRFSTPQPSGALPGRINPRTPTPARGSSSTSSNASTATSIHSNQTVSTRLGSTAGSGTNVSSLPSTARTRSWVEDQNRNLSPFMRGAHNISFVTPPSSRSSSQGTVSTVPKEVLNSWTGAFNTRRQPLFAHIRRQGESRV

SEQ ID NO: 4191 - protein, 268 aa, Artificial Sequence
  capsid_protein_VP2__Norovirus__AFI08238
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPGRINPRTPTPARGSSSTSSNASTATSIHSNQTVSTRLGSTAGSGANVSSLPSTARTRSWVEDQNRNLSPFMRGAHNISFVTPPSSRSSSQGTVSTVPKEVLDSWAGAFNTRRQPLFAHIRRRGESRV

SEQ ID NO: 4192 - protein, 268 aa, Artificial Sequence
  capsid_protein_VP2__Norovirus__AFI08241
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPGRTNPRTPTPARGSSSASSNASTATSILSNQTASTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4193 - protein, 268 aa, Artificial Sequence
  capsid_protein_VP2__Norovirus__AFI08244
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTHNAGRFSTPQPSGTLPGRINPRTPTPARGSSNTSSNASTATSIHSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4194 - protein, 268 aa, Artificial Sequence
  capsid_protein_VP2__Norovirus__AFJ38520
MAGPFFAGLASDVLGSGLGSLINAGAGAINQKVEFENNRKLQQASFQFSSNLQQASFQHDKEMLQAQIEATQKLQQGLMKVKQAVLLEGGFSTTDAARGAINAPMTKALDWSGTRYWAPDARATTYNAGRFSTPQPLGALPGRINPRVPAPARSSPSSLSNAPTATSVYSNQTVSTRLGSSAGSGAGVSSLPSTARTRSWVEDQNRNLSPFMRGALNTSFVTPPSSRSSNQGTVSTVPKEILDSWTGAFNTRRQPLFAHIRKRGESRV

SEQ ID NO: 4195 - protein, 254 aa, Artificial Sequence
  capsid_protein_VP2__Norovirus__AFX71657
MAGAFIAGLAGDMLTSTVGSLVNAGASAINQKVDFENNKYLQNASFNHDKEMLNAQIEATKRLQADMIAIKQGVLTAGGFSPTDAARGAINAPITRVLDWSGTRYWAPNATSTTSMSGGFTSQTVHRTTPNFKTNQAPKSTPSSGSSVRSNSTQLTSLSSHSSGSSRSSGSTVVSSLPSSNRTRDWVNQQNFNLEPHMPGSLRTAFVTPPSSTASNSDTVSTVPKSVLDSWTSAFNTRRQPLFAHLRRRGESNV

SEQ ID NO: 4196 - protein, 259 aa, Artificial Sequence
  capsid_protein_VP2__Norovirus__AFX71660
MAGAFVAGLAGDVLSNGLSSLINAGANAINQRAEFDFNQRLQQNSFNHDKEMLQAQIQATKQLQADMMAIKQGVLTAGGFSPTDAARGAVNAPMTQALDWNGTRYWAPGSMRTTSYSGRFTSTAPARQADFQHTQNRPSSGSSVSSYTTQSSRPTLTTTTGSSHGTTSSNSTRSTNLSQSTVSRATSRTSEWVRDQNRNLEPYMHGALQTAFVTPPSSRASDGTVSTVPKGVLDSWTPAFNTRRQPLFAHLRKRGESRV

SEQ ID NO: 4197 - protein, 259 aa, Artificial Sequence
  capsid_protein_VP2__Norovirus__AFX71666
MAGAFFAGLAGDVVSNGIGSLINAGANAVNQKVEYDFNKQLQMASFKHDKEMLQSQVLATKQLQQEMMNIRQGVLTAGGFSPADAARGAVNAPMTKILDWNGTRYWAPNSMKTTSYSGQFSSSPVHRPPAAPQHTAPPKSKLQGDSVSVYSSPSTVSSQSTHSTVLSAGTGSSRSTSTSTAASTLSRTSDWVRGQNERLSPFMDGALQTTFVTPPSSKASSNGTVSTVPKAVLDSWTPTFNTHRQPLFAHLRRRGESQI

SEQ ID NO: 4198 - protein, 268 aa, Artificial Sequence
  capsid_protein_VP2__Norovirus__AFX71669
MAGAFFAGLASDVLGSGLGSLINAGAGVINQKVDFENNRKLQQASFQFSSNQQQASFQHDKEMLQAQIEATKKLQQEMMRVKQAMLLEGGFSETDAARGAINAPMTKALDWSGTRYWAPDARTTTYNAGRFSTPQPSGASPGRANLRATVPARGSSSTSSNSSIATSVYSNQTTSTRLGSTAGSGTSVSSLPSTARTMSWVEDQNRNLSPFMRGAHNISFVTPPSSRSSSQGTVSTVPKEVLDSWTGAFNTRRQPLFAHIRKRGESRV

SEQ ID NO: 4199 - protein, 268 aa, Artificial Sequence
  capsid_protein_VP2__Norovirus__AFX81122
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPGRTNPRTPTPARGSSSTSSNASTATSILSNQTASTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4200 - protein, 268 aa, Artificial Sequence
  capsid_protein_VP2__Norovirus__AFX81125
MAGAFFAGLASDVLGSGLGSLINAGAGAINQKIDFENNRKLQQASFQFSSNLQQASFQHDKEMLQAQIEATKKLQQEIMKAKQAMLLEGGFSETDAARGAINAPMTKVLDWSGTRYWAPDARTATYNAGRFSTPQPSGTLPGRINPRTPTPARGSSSTSSNASTATSIHSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4201 - protein, 268 aa, Artificial Sequence
  capsid_protein_VP2__Norovirus__AFX81131
MAGAFFAGLASDVLGSGLGSLINAGAGAINQKIDFENNRKLQQASFQFSSNLQQASFQHDKEMLQAQIEATKKLQQEVMKVKQAMLLEGGFSETDAARGAINAPMTKVLDWSGTRYWAPDARTTTYNAGRFSTPQPSGTLPGRINPRTPTPARGSSSTSSNASTATSIHSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4202 - protein, 268 aa, Artificial Sequence
  capsid_protein_VP2__Norovirus__AFX81134
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPGRINPRTPTPARGSSSTSSNASTATSIHSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4203 - protein, 268 aa, Artificial Sequence; identical to SEQ ID NO: 4202
  capsid_protein_VP2__Norovirus__AFX81137

SEQ ID NO: 4204 - protein, 268 aa, Artificial Sequence
  capsid_protein_VP2__Norovirus__AFX81140
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPGRINPRTPTPARGSSSTSSSASTATSIHSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4205 - protein, 268 aa, Artificial Sequence
  capsid_protein_VP2__Norovirus__AFX81143
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPGRINPRIPTPARGSSSTSSNASTATSIYSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4206 - protein, 268 aa, Artificial Sequence; identical to SEQ ID NO: 4202
  capsid_protein_VP2__Norovirus__AFX81149

SEQ ID NO: 4207 - protein, 268 aa, Artificial Sequence
  capsid_protein_VP2__Norovirus__AFX81152
MAGAFFAGLASDVLGSGLGSLINAGAGAINQKIDFENNRKLQQASFQFSSNLQQASFQHDKEMLQAQIEATKKLQQGMMKVKQAMLLEGGFSETDAARGAINAPMTKVLDWSGTRYWAPDARTTTYNAGRFSTPQPSGTLPGRINPRTPTPARGSSSTSSNASTATSIHSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4208 - protein, 268 aa, Artificial Sequence
  capsid_protein_VP2__Norovirus__AFX81155
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPGRINPRTPTPARGSSSTSSNASTATSIHSNQTVSTRLGSTAGSGTNVPSLPSTARTRSWVEDQNRNLSPFMRGAQNISFVTPPSSRSSSQGTVSTVPKEVLDSWTGAFNTRRQPLFAHIRRRGESRV

SEQ ID NO: 4209 - protein, 268 aa, Artificial Sequence
  capsid_protein_VP2__Norovirus__AFX81158
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPGRINPRTLTPARGSSSTSSNASTATSIHSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4210 - protein, 268 aa, Artificial Sequence
  capsid_protein_VP2__Norovirus__AFX81164
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPGRINPRTPTPARGSSSTSSNASTATSIYSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4211 - protein, 268 aa, Artificial Sequence; identical to SEQ ID NO: 4202
  capsid_protein_VP2__Norovirus__AFX81173

SEQ ID NO: 4212 - protein, 268 aa, Artificial Sequence; identical to SEQ ID NO: 4202
  capsid_protein_VP2__Norovirus__AFX81179

SEQ ID NO: 4213 - protein, 268 aa, Artificial Sequence; identical to SEQ ID NO: 4210
  capsid_protein_VP2__Norovirus__AFX81182

SEQ ID NO: 4214 - protein, 268 aa, Artificial Sequence
  capsid_protein_VP2__Norovirus__AFX81185
MAGAFFAGLASDVLGSGLGSLINAGAGAINQKVDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPGRINPRTPTPARGSSSTSSNASTATSIHSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4215 - protein, 268 aa, Artificial Sequence; identical to SEQ ID NO: 4202
  capsid_protein_VP2__Norovirus__AFX81188

SEQ ID NO: 4216 - protein, 268 aa, Artificial Sequence; identical to SEQ ID NO: 4202
  capsid_protein_VP2__Norovirus__AFX81191

SEQ ID NO: 4217 - protein, 268 aa, Artificial Sequence
  capsid_protein_VP2__Norovirus__AFX81194
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPGRVNPRTPTPARGSSSTSSNASIATSIYSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4218 - protein, 268 aa, Artificial Sequence; identical to SEQ ID NO: 4202
  capsid_protein_VP2__Norovirus__AFX81197

SEQ ID NO: 4219 - protein, 268 aa, Artificial Sequence
  capsid_protein_VP2__Norovirus__AFX81200
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPGRINPRTPTPARGSSSTSSNVSTATSIYLNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4220 - protein, 268 aa, Artificial Sequence; identical to SEQ ID NO: 4210
  capsid_protein_VP2__Norovirus__AFX81203

SEQ ID NO: 4221 - protein, 268 aa, Artificial Sequence
  capsid_protein_VP2__Norovirus__AFX81206
MAGAFFAGLASDVLGSGLSSLINAGAGAINQKIDFENNRKLQQASFQFSSNLQQASFQHDKEMLQAQIEATKKLQQEMMKVKQAMLLEGGFSETDAARGAVNAPMTKVLDWSGTRYWAPDARTTTYNAGRFSTPQPSGTLPGRINPRTPTPARGSSSTSSNASTATSIYSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4222 - protein, 268 aa, Artificial Sequence; identical to SEQ ID NO: 4210
  capsid_protein_VP2__Norovirus__AFX81209

SEQ ID NO: 4223 - protein, 268 aa, Artificial Sequence
  capsid_protein_VP2__Norovirus__AFX81212
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPGRINPRTPTPARGSSSTTSNASTATSIHSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4224 - protein, 268 aa, Artificial Sequence
  capsid_protein_VP2__Norovirus__AFX81215
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAVNAPMTKVLDWSGTRYWAPDARTTTYNAGRFSTPQPSGTLPGRINPRTPTPARGSSSTSSNAPIATSIYSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4225 - protein, 268 aa, Artificial Sequence; identical to SEQ ID NO: 4210
  capsid_protein_VP2__Norovirus__AFX81218

SEQ ID NO: 4226 - protein, 268 aa, Artificial Sequence
  capsid_protein_VP2__Norovirus__AFX81221
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPGRINPRTPTPARGSPSTSSNASTATSIYSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4227 - protein, 268 aa, Artificial Sequence; identical to SEQ ID NO: 4210
  capsid_protein_VP2__Norovirus__AFX81224

SEQ ID NO: 4228 - protein, 268 aa, Artificial Sequence; identical to SEQ ID NO: 4210
  capsid_protein_VP2__Norovirus__AFX81227

SEQ ID NO: 4229 - protein, 268 aa, Artificial Sequence
  capsid_protein_VP2__Norovirus__AFX81230
MAGAFFAGLASDVLGSGLGSLINAGAGAINQKIDFENNRKLQQASFQFSSDLQQASFQHDKEMLQAQIEATKKLQQEMMKVKQAMLLEGGFSETDAARGAINAPMTKVLDWSGTRYWAPDARTTTYNAGRFSTPQPSGTLPGRINPRTPAPARGSSSTSSNASTATSIYSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4230 - protein, 268 aa, Artificial Sequence
  capsid_protein_VP2__Norovirus__AFX81233
MAGAFFAGLASDVLGSGLGSLINAGAGAINQKIDFENNRKLQQASFQFSSNLQQASFQHDKEMLQAQIEATKKLQQEMMRVKQAMLLEGGFSETDAARGAINAPMTKVLDWSGTRYWAPDARTTTYNAGRFSTPQPSGTLPGRINPRTPTPARGSSSTSSNVSTATSIYSNQTFSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4231 - protein, 268 aa, Artificial Sequence
  capsid_protein_VP2__Norovirus__AFX81239
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPGRINPRTPTPARGSSSTSSNVSTATSIYSNQTASTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4232 - protein, 268 aa, Artificial Sequence
  capsid_protein_VP2__Norovirus__AFX81242
MAGAFFAGLASDVLGSGLGSLINAGAGAINQKVEFENNRKLQQASFQFSSNLQQASFQHDKEMLQAQIEATKKLQQEMMRVKQAMLLEGGFSETDAARGAINAPMTKTLDWTGTRYWAPDARTTTYNAGRFSTPQPSGALPGRANLRATVPARGSSSTFSNSSIATSVYSNQTTSTRLGSTAGSGTSVSSLPSTARTRSWVEDQNRNLSPFMRGAHNISFVTPPSSRSSSQGTVSTVPKEVLDSWTGAFNTRRQPLFAHIRKRGESRV

SEQ ID NO: 4233 - protein, 268 aa, Artificial Sequence
  capsid_protein_VP2__Norovirus__AFX81245
MAGAFFAGLASDVLGSGLGSLINAGAGAINQKVEFENNRKLQQASFQFSSSLQQASFQHDKEMLQAQIEATKKLQQEMMRVKQAMLLEGGFSETDAARGAINAPMTKTLDWSGTRYWAPDARTTTYNAGRFSTPQPSGALPGRANLRATVPARGSSSTSSNSSIATSVYSNQTTSTRLGSTAGSGTSVSSLPSTARTRSWVEDQNRNLSPFMRGAHNISFVTPPSSRSSSQGTVSTVPKEVLDSWTGAFNTRRQPLFAHIRKRGESRV

SEQ ID NO: 4234 - protein, 268 aa, Artificial Sequence
  capsid_protein_VP2__Norovirus__AFX81248
MAGAFFAGLASDVLGSGLGSLINAGAGAINQKVEFENNRKLQQASFQFSSNLQQASFQHDKEMLQAQIEATRKLQQEMMRVKQAMLLEGGFSETDAARGAINAPMTKTLDWSGTRYWAPDARTTTYNAGRFSTPQPSGALPGRANLRATVPARGSSSTFSNSSIATSVYSNQTTSTRLGSTAGSGTSVSSLPSTARTRSWVEDQNRNLSPFMRGAHNISFVTPPSSRSSSQGTVSTVPKEVLDSWTGAFNTRRQPLFAHIRKRGESRV

SEQ ID NO: 4235 - protein, 268 aa, Artificial Sequence
  capsid_protein_VP2__Norovirus__AFX81251
MAGAFFAGLASDVLGSGLGSLINAGAGAINQKVEFENNRKLQQASFQFSSNLQQASFQHDKEMLQAQIEATKKLQQEMMRVKQAMLLEGGFSETDAARGAINAPMTKTLDWSGTRYWAPDARTTTYNAGRFSTPQPSGALPGRANLRATVPARGSSSTFSNSSIATSVYSNQTTSTRLGSTAGSGASVSSLPSTARTRSWVEDQNRNLSPFMRGAHNISFVTPPSSRSSSQGTVSTVPKEVLDSWTGAFNTRRQPLFAHIRKRGESRV

SEQ ID NO: 4236 - protein, 268 aa, Artificial Sequence
  capsid_protein_VP2__Norovirus__AFX81254
MAGAFFAGLASDVLGSGLGSLINAGAGAINQTVEFENNRKLQQASFQFSSNLQQASFQHDKEMLQAQIEATKKLQQEMMRVKQAMLLEGGFSETDAARGAINAPMTKTLDWTGTRYWAPDARTTTYNAGRFSTPQPSGALPGRANLRATVPARGSSSTFSNSSIATSVYSNQTTSTRLGSTAGSGTSVSSLPSTARTRSWVEDQNRNLSPFMRGAHNISFVTPPSSRSSSQGTVSTVPKEVLDSWTGAFNTRRQPLFAHIRKRGESRV

SEQ ID NO: 4237 - protein, 268 aa, Artificial Sequence
  capsid_protein_VP2__Norovirus__AFX81257
MAGAFFAGLASDVLGSGLGSLINAGAGAINQKVEFENNRKLQQASFQFSSSLQQASFQHDKEMLQAQIEATKKLQQEMMRVKQAMLLEGGFSETDAARGAINAPMTKTLDWSGTRYWAPDARTTTYNAGRFSTPQPSGALPGRANLRATVPARGSSSTSSNSSIATSVYSNQTTSTRLGSTAGSGTSVSSHPSTARTRSWVEDQNRNLSPFMRGAHNISFVTPPSSRSSSQGTVSTVPKEVLDSWTGAFNTRRQPLFAHIRKRGESRV

SEQ ID NO: 4238 - protein, 268 aa, Artificial Sequence
  capsid_protein_VP2__Norovirus__AFX81260
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPGRINPRTPTPARGSSSTSSNASTATSIHSNQTVSTRLGSTAGSGTNVSSLPSTARTRSWVEDQNRNLSPFMRGAHNISFVTPPSSRSSSQGTVSTVPKEVLDSWTGAFNTRRQPLFAHTRRRGESRV

SEQ ID NO: 4239 - protein, 268 aa, Artificial Sequence; identical to SEQ ID NO: 4210
  capsid_protein_VP2__Norovirus__AFX81263

SEQ ID NO: 4240 - protein, 268 aa, Artificial Sequence; identical to SEQ ID NO: 4210
  capsid_protein_VP2__Norovirus__AFX81269

SEQ ID NO: 4241 - protein, 268 aa, Artificial Sequence; identical to SEQ ID NO: 4202
  capsid_protein_VP2__Norovirus__AFX81272

SEQ ID NO: 4242 - protein, 268 aa, Artificial Sequence; identical to SEQ ID NO: 4210
  capsid_protein_VP2__Norovirus__AFX81275

SEQ ID NO: 4243 - protein, 268 aa, Artificial Sequence; identical to SEQ ID NO: 4210
  capsid_protein_VP2__Norovirus__AFX81278

SEQ ID NO: 4244 - protein, 268 aa, Artificial Sequence
  capsid_protein_VP2__Norovirus__AFX81281
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGALPGRINPRTPTPARGSSSTSSNASTATSIHSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4245 - protein, 268 aa, Artificial Sequence; identical to SEQ ID NO: 4210
  capsid_protein_VP2__Norovirus__AFX81284

SEQ ID NO: 4246 - protein, 268 aa, Artificial Sequence
  capsid_protein_VP2__Norovirus__AFX81287
MAGAFFAGLASDVLGSGLSSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPGRINPRTPTPARGSSSTSSNAPTATSIHSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4247 - protein, 268 aa, Artificial Sequence; identical to SEQ ID NO: 4210
  capsid_protein_VP2__Norovirus__AFX81290

SEQ ID NO: 4248 - protein, 268 aa, Artificial Sequence; identical to SEQ ID NO: 4202
  capsid_protein_VP2__Norovirus__AFX81293

SEQ ID NO: 4249 - protein, 268 aa, Artificial Sequence
  capsid_protein_VP2__Norovirus__AFX81296
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPGRVNPRTPTPARGSSSTSSNASTATSIHSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4250 - protein, 268 aa, Artificial Sequence
  capsid_protein_VP2__Norovirus__AFX81299
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWTPDARTTTYNAGRFSTPQPSGTLPGRINPRTPTPARGSSSTSSNASTATSIHSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4251 - protein, 268 aa, Artificial Sequence
  capsid_protein_VP2__Norovirus__AFX81302
MAGAFFAGLASDVLSSGLGSLINAGAGAINQKIDFENNRKLQQASFQFSSNLQQASFQHDKEMLQAQIEATKKLQQEMMKVKQAMLLEGGFSETDAARGAINAPMTKALDWSGTRYWAPDARTTTYSAGRFSTPQPSGALPGRTNPRAPIPARGSPSTSSGASTATSIYSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4252 - protein, 268 aa, Artificial Sequence
  capsid_protein_VP2__Norovirus__AFX81305
MAGAFFAGLASDVLGSGLGSLINAGAGAINQKIDFENNRKLQQASFQFSSDLQQASFQHDKEMLQAQIEATKKLQQEMMKVKQAMLLEGGFSETDAARGAINAPMTKVLDWSGTRYWAPDARTTTYSAGRFSTPQPSGTLPGRTNPRTPTPARGSSSTSSNASTATSIHSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4253 - protein, 268 aa, Artificial Sequence; identical to SEQ ID NO: 4202
  capsid_protein_VP2__Norovirus__AFX81308

SEQ ID NO: 4254 - protein, 268 aa, Artificial Sequence; identical to SEQ ID NO: 4210
  capsid_protein_VP2__Norovirus__AFX81311

SEQ ID NO: 4255 - protein, 268 aa, Artificial Sequence; identical to SEQ ID NO: 4202
  capsid_protein_VP2__Norovirus__AFX81314

SEQ ID NO: 4256 - protein, 268 aa, Artificial Sequence; identical to SEQ ID NO: 4202
  capsid_protein_VP2__Norovirus__AFX81317

SEQ ID NO: 4257 - protein, 268 aa, Artificial Sequence; identical to SEQ ID NO: 4202
  capsid_protein_VP2__Norovirus__AFX81320

SEQ ID NO: 4258 - protein, 268 aa, Artificial Sequence
  capsid_protein_VP2__Norovirus__AFX81323
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYSAGRFSTPQPSGTLPGRINPRTPTPARGSSSTSSNASTATSIHSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4259 - protein, 268 aa, Artificial Sequence; identical to SEQ ID NO: 4210
  capsid_protein_VP2__Norovirus__AFX81326

SEQ ID NO: 4260 - protein, 268 aa, Artificial Sequence; identical to SEQ ID NO: 4202
  capsid_protein_VP2__Norovirus__AGE89434

SEQ ID NO: 4261 - protein, 268 aa, Artificial Sequence; identical to SEQ ID NO: 4202
  capsid_protein_VP2__Norovirus__AGE89437

SEQ ID NO: 4262 - protein, 268 aa, Artificial Sequence
  capsid_protein_VP2__Norovirus__AGE89440
MAGAFFAGLASDVLGSGLGSLISAGAGAINQKVEFENNRKLQQASFQFSSNLQQASFQHDKEMLQAQIEATKKLQQEMMRVKQAMLLEGGFSETDAARGAINAPMTKTLDWSGTRYWAPDARTTTYNAGRFSTPQPSGALPGRANLRATVPARGSSSTFSNSSIATSVYSNQTTSTRLGSTAGSGTSVSSLPSTARTRSWVEDQNRNLSPFMRGAHNISFVTPPSSRSSSQGTVSTVPKEVLDSWTGAFNTRRQPLFAHIRKRGESRV

SEQ ID NO: 4263 - protein, 268 aa, Artificial Sequence
  capsid_protein_VP2__Norovirus__AGE89443
MAGAFFAGLASDVLGSGLGSLINAGAGAINQKVEFENNRKLQQASFQFSSNLQQASFQHDKEMLQAQIEATKKLQQEMMRVKQAMLLEGGFSETDAARGAINAPMTKTLDWSGTRYWAPDARTTTYNAGRFSTPQPSGALPGRANLRATVPARGSSSTSSNASIATSVYSNQTTSTRLGSTAGSGTSVSSLPSTARTRSWVEDQNRNLSPFMRGAHNISFVTPPSSRSSSQGTVSTVPKEVLDSWTGAFNTRRQPLFAHIRKRGESRV

SEQ ID NO: 4264 - protein, 268 aa, Artificial Sequence
  capsid_protein_VP2__Norovirus__AGE89449
MAGAFFAGLASDVLGSGLGSLINAGAGAINQKVEFENNRKLQQASFQFSSNLQQASFQHDKEMLQAQIEATKKLQQEMMRVKQAMLLEGGFSETDAARGAINAPMTKTLDWSGTRYWAPDARTTTYNAGRFSTPQPSGVLPGRANLRATVPARGSSSTFSNSSIATSVYSNQTTSTRLGSTAGSGTSVSSLPSTARTRSWVEDQNRNLSPFMRGAHNISFVTPPSSRSSSQGTVSTVPKEVLDSWTGAFNTRRQPLFAHIRKRGESRV

SEQ ID NO: 4265 - protein, 268 aa, Artificial Sequence; identical to SEQ ID NO: 4244
  capsid_protein_VP2__Norovirus__AGE89455

SEQ ID NO: 4266 - protein, 268 aa, Artificial Sequence; identical to SEQ ID NO: 4202
  capsid_protein_VP2__Norovirus__AGE89458

SEQ ID NO: 4267 - protein, 268 aa, Artificial Sequence; identical to SEQ ID NO: 4210
  capsid_protein_VP2__Norovirus__AGE89461

SEQ ID NO: 4268 - protein, 268 aa, Artificial Sequence
  capsid_protein_VP2__Norovirus__AGE89464
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPGRINPRTPTPARGSSSTPSNASTATSIHSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4269 - protein, 268 aa, Artificial Sequence; identical to SEQ ID NO: 4202
  capsid_protein_VP2__Norovirus__AGE89467

SEQ ID NO: 4270 - protein, 268 aa, Artificial Sequence
  capsid_protein_VP2__Norovirus__AGE89470
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARATTYNAGRFSTPQPSGTLPGRINPRTPTPARGSPSTSSNASTATSIYSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4271 - protein, 268 aa, Artificial Sequence
  capsid_protein_VP2__Norovirus__AGE89473
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGALPGRINPRTPTPARGSSSTSSNASIATSIHSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4272 - protein, 268 aa, Artificial Sequence
  capsid_protein_VP2__Norovirus__AGE89476
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPGRINPRTPTPARGSSSTSFNASTATSIHSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4273 - protein, 268 aa, Artificial Sequence
  capsid_protein_VP2__Norovirus__AGE89479
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQSSGTLPGRINPRTPTPARGSSSTSSNASTATSIHSNQTVSTRLGSTAGSGTNVSSHPSTARTRSWVEDQNRNLSPFMRGAHNISFVTPPSSRSSSQGTVSTVPKEVLDSWTGAFNTRRQPLFAHIRRRGESRV

SEQ ID NO: 4274 - protein, 268 aa, Artificial Sequence; identical to SEQ ID NO: 4210
  capsid_protein_VP2__Norovirus__AGE89482

SEQ ID NO: 4275 - protein, 268 aa, Artificial Sequence
  capsid_protein_VP2__Norovirus__AGE89485
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPGRINPRTPTPARGSSSTSSNASTATSIHSNQTVSTRLGSTAGSGTNVSSLPSTARTRSWVEDQNRNLSPFMRGARNISFVTPPSSRSSSQGTVSTVPKEVLDSWTGAFNTRRQPLFAHIRRRGESRV

SEQ ID NO: 4276 - protein, 268 aa, Artificial Sequence
  capsid_protein_VP2__Norovirus__AGE89488
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSAPQPSGSLPGRINPRAPTPARVSSSTSSNASTVTSIYSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4277 - protein, 268 aa, Artificial Sequence; identical to SEQ ID NO: 4202
  capsid_protein_VP2__Norovirus__AGE89491

SEQ ID NO: 4278 - protein, 268 aa, Artificial Sequence
  capsid_protein_VP2__Norovirus__AGE89494
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTITYNAGRFSTPQPSGTLPGRINPRAPTPARGSSSTSSNASTATSIYSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4279 - protein, 268 aa, Artificial Sequence
  capsid_protein_VP2__Norovirus__AGE89497
MAGAFFAGLASDVLGSGLGSLISAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPGRINPRTPTPARGSSSTSSNASTATSIYSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4280 - protein, 268 aa, Artificial Sequence; identical to SEQ ID NO: 4202
  capsid_protein_VP2__Norovirus__AGE89500

SEQ ID NO: 4281 - protein, 268 aa, Artificial Sequence; identical to SEQ ID NO: 4202
  capsid_protein_VP2__Norovirus__AGE89503

SEQ ID NO: 4282 - protein, 268 aa, Artificial Sequence
  capsid_protein_VP2__Norovirus__AGE89506
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPGRINPRTPTPARGSSSTSSNASTATSMHSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4283 - protein, 268 aa, Artificial Sequence
  capsid_protein_VP2__Norovirus__AGE89509
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGSLPGRINPRAPTPARASSSISSNASTVTSIYSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4284 - protein, 268 aa, Artificial Sequence; identical to SEQ ID NO: 4202
  capsid_protein_VP2__Norovirus__AGE89512

SEQ ID NO: 4285 - protein, 268 aa, Artificial Sequence; identical to SEQ ID NO: 4210
  capsid_protein_VP2__Norovirus__AGE89515

SEQ ID NO: 4286 - protein, 268 aa, Artificial Sequence
  capsid_protein_VP2__Norovirus__AGE89518
MAGAFFAGLASDVLGSGLGSLINAGAGAINQKIDFENNRKLQQASFQFSSNLQQASFQHDKEMLQAQIEATKKLQQEMMKVKQTMLLEGGFSETDAARGAINAPMTKVLDWSGTRYWAPDARTTTYNAGRFSTPQPSGTLPGRINPRTPTPARGSSSTSSNASTATSIHSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4287 - protein, 268 aa, Artificial Sequence
  capsid_protein_VP2__Norovirus__AGE89521
MAGAFFAGLASDVLGSGLGSLINAGAGAINQKIDFENNRKLQQVSFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPGRINPRTPTPARGSSSTSSNASTATSIHSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4288 - protein, 268 aa, Artificial Sequence; identical to SEQ ID NO: 4202
  capsid_protein_VP2__Norovirus__AGE89524

SEQ ID NO: 4289 - protein, 268 aa, Artificial Sequence
  capsid_protein_VP2__Norovirus__AGE89530
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPGRTNPRTPTPARGSSSTSSNASTATSIYSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4290 - protein, 268 aa, Artificial Sequence
  capsid_protein_VP2__Norovirus__AGE89533
MAGAFFAGLASDVLGSGLGSLINAGAGAINQKIDFENNRKLQQASFQFSSNLQQASFQHDKEMLQAQIEATKKLQQEIMKVKQAMLLEGGFSETDAARGAINAPMTKVLDWSGTRYWAPDARTTTYSAGRFSTPQPSGTLPGRINPRTPTPARGSSSTFSNASTATSIHSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4291 - protein, 268 aa, Artificial Sequence; identical to SEQ ID NO: 4210
  capsid_protein_VP2__Norovirus__AGE89536

SEQ ID NO: 4292 - protein, 268 aa, Artificial Sequence; identical to SEQ ID NO: 4210
  capsid_protein_VP2__Norovirus__AGE89539

SEQ ID NO: 4293 - protein, 268 aa, Artificial Sequence; identical to SEQ ID NO: 4210
  capsid_protein_VP2__Norovirus__AGE89542

SEQ ID NO: 4294 - protein, 268 aa, Artificial Sequence; identical to SEQ ID NO: 4210
  capsid_protein_VP2__Norovirus__AGE89545

SEQ ID NO: 4295 - protein, 268 aa, Artificial Sequence
  capsid_protein_VP2__Norovirus__AGE89548
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARITTYNAGRFSTPQPSGTLPGRINPRTPTPARGSSSTSSNASTATSIHSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4296 - protein, 268 aa, Artificial Sequence; identical to SEQ ID NO: 4202
  capsid_protein_VP2__Norovirus__AGE89551

SEQ ID NO: 4297 - protein, 268 aa, Artificial Sequence
  capsid_protein_VP2__Norovirus__AGE89554
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSAPQPSGSLPGRINPRAPTPARVSSSTSSNASTVTSIYSNQTVSTRLGSTAGSGTNVSSLPSTARTRSWVEDQNRNLSPFMRGAHNISFVTPPSSRSSSQGTVSTVPKEVLDSWTGAFNTRRQPLFAHVRRRGESRV

SEQ ID NO: 4298 - protein, 268 aa, Artificial Sequence; identical to SEQ ID NO: 4210
  capsid_protein_VP2__Norovirus__AGE89557

SEQ ID NO: 4299 - protein, 268 aa, Artificial Sequence
  capsid_protein_VP2__Norovirus__AGE89560
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPGRINSRTPTPARGSSSTSSNASTATSIYSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4300 - protein, 268 aa, Artificial Sequence
  capsid_protein_VP2__Norovirus__AGE89563
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGMLPGRINPRTPTPARGSSSTSSNASTATSIHSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4301 - protein, 268 aa, Artificial Sequence
  capsid_protein_VP2__Norovirus__AGE89566
MAGAFFAGLASDVLSSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPGRINPRIPTPARGSSSTSSNASTATSIYSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4302 - protein, 268 aa, Artificial Sequence; identical to SEQ ID NO: 4210
  capsid_protein_VP2__Norovirus__AGE89569

SEQ ID NO: 4303 - protein, 268 aa, Artificial Sequence; identical to SEQ ID NO: 4210
  capsid_protein_VP2__Norovirus__AGE89572

SEQ ID NO: 4304 - protein, 268 aa, Artificial Sequence
  capsid_protein_VP2__Norovirus__AGE89578
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLLERVNPRTPTPARGSSSTSSNASTATSIHSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4305 - protein, 268 aa, Artificial Sequence
  capsid_protein_VP2__Norovirus__AGE89581
MAGAFFAGLASDVLGSGLGSLINAGAGAINQKIDFENNRKLQQASFQFSSNLQQASFQHDKEMLQAQIEATKKLQQEVMKVKQAMLLEGGFSETDAARGAINAPMTKVLDWSGTRYWAPDARTTTYNAGRFSTPQPSGTLPGRINPRTPTPARGSSSTSSNASTATSIYSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4306 - protein, 268 aa, Artificial Sequence; identical to SEQ ID NO: 4300
  capsid_protein_VP2__Norovirus__AGE89587

SEQ ID NO: 4307 - protein, 268 aa, Artificial Sequence
  capsid_protein_VP2__Norovirus__AGE89590
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPERVNPRTPTPARGSSSTSSNASTATSIHSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4308 - protein, 268 aa, Artificial Sequence; identical to SEQ ID NO: 4202
  capsid_protein_VP2__Norovirus__AGE89593

SEQ ID NO: 4309 - protein, 268 aa, Artificial Sequence
  capsid_protein_VP2__Norovirus__AGE89596
MAGAFFAGLASDVLGSGLGSLINAGAGAINQKVEFENNRKLQQASFQFSSNLQQASFQHDKEMLQAQIEATKKLQQEMMRVKQAMLLEGGFSETDAARGAINAPMTKTLDWSGTRYWAPDARTTTYNAGRFSTPQPSGALPGRANLRATVPARGSSSTSSNSSIATSVYSNQTTSTRLGSTAGSGTSVSSLPSTARTRSWVEDQNRNLSPFMRGAHNISFVTPPSSRSSSQGTVSTVPKEVLDSWTGAFNTRRQPLFAHIRKRGESRV

SEQ ID NO: 4310 - protein, 268 aa, Artificial Sequence
  capsid_protein_VP2__Norovirus__AGE89599
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPGRTNPRTPTPARGSSSISSNASTATSIHSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4311 - protein, 268 aa, Artificial Sequence
  capsid_protein_VP2__Norovirus__AGE89602
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPGRINPRTPTPARGSSSTSSNASTATSIHSNQTASTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4312 - protein, 268 aa, Artificial Sequence
  capsid_protein_VP2__Norovirus__AGE89605
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPGRINPRTPTPARGSSSTSSNASTATSIHSNQTVSTRLGSTAGSGTNVSSLPSTARTRSWVEDQNRSLSPFMRGAHNISFVTPPSSRSSSQGTVSTVPKEVLDSWTGAFNTRRQPLFAHIRRRGESRV

SEQ ID NO: 4313 - protein, 268 aa, Artificial Sequence
  capsid_protein_VP2__Norovirus__AGE89608
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPGRINPRTPTPARGSSSTSSNASTATSIHSNQTVSTRLGYTAGSGTNVSSLPSTARTRSWVEDQNRSLSPFMRGAHNISFVTPPSSRSSSQGTVSTVPKEVLDSWTGAFNTRRQPLFAHIRRRGESRV

SEQ ID NO: 4314 - protein, 268 aa, Artificial Sequence
  capsid_protein_VP2__Norovirus__AGE89611
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAISAPMTKVLDWSGTRYWAPDARTTTYNAGRFSTPQPSGTLPGRINPRTPTPARGSSSTSSNAPTATSIYSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4315 - protein, 268 aa, Artificial Sequence
  capsid_protein_VP2__Norovirus__AGE89614
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSETLPGRINPRTPTPARGSSSTSSNASTATSIHSNQTVSTRLGSTAGSGTNVSSLPSTARTRSWVEDQNRSLSPFMRGAHNISFVTPPSSRSSSQGTVSTVPKEVLDSWTGAFNTRRQPLFAHIRRRGESRV

SEQ ID NO: 4316 - protein, 268 aa, Artificial Sequence; identical to SEQ ID NO: 4309
  capsid_protein_VP2__Norovirus__AGE89617

SEQ ID NO: 4317 - protein, 268 aa, Artificial Sequence; identical to SEQ ID NO: 4217
  capsid_protein_VP2__Norovirus__AGE89620

SEQ ID NO: 4318 - protein, 268 aa, Artificial Sequence
  capsid_protein_VP2__Norovirus__AGE89623
MAGAFFAGLASDVLGSGLGSLINAGAGAINQKVEFENNRKLQQASFQFSSNLQQASFQHDKEMLQAQIEATKKLQQEMMRVKQAMLLEGGFSETDAARGAINAPMTKTLDWSGTRYWAPDARTTTYNAGRFSTPQPSGALPGRANLRATVPARGSSSTFSNSSIATSVYSNQTTSTRLGSTAGSGTSVSSLPSTARTRSWVEDQNRNLSPFMRGAHNISYVTPPSSRSSSQGTVSTVPKEVLDSWTGAFNTRRQPLFAHIRKRGESRV

SEQ ID NO: 4319 - protein, 268 aa, Artificial Sequence
  capsid_protein_VP2__Norovirus__AGE89626
MAGAFFAGLASDVLGSGLGSLINAGAGAINQKVEFENNRKLQQASFQFSSNLQQASFQHDKEMLQAQIEATKKLQQEMMRVKQAMLLEGGFSETDAARGAINAPMTKTLDWSGTRYWAPDARTTTYNAGRFSTPQPSGALPGRANLRATVPARGSSSTFSNSSIATSVYSNQTTSTRLGSTAGSGTSVSSLPSTARTRSWVEDQNRNLSPFMRGAHNISFVTPPSSRSSSQGTVSTVPKEVLDSWTGAFNTRRQPLFAHIRKRGESRV

SEQ ID NO: 4320 - protein, 268 aa, Artificial Sequence
  capsid_protein_VP2__Norovirus__AGE89629
MAGAFFAGLASDVLGSGLGSLINAGAGAINQKVEFENNRKLQQASFQFSSNLQQASFQHDKEMLQAQIEATKKLQQEMMRVKQAMLLEGGFSETDAARGAINAPMTKTLDWSGTRYWAPDARTTTYNAGRFSTPQPSGALPGGANLRATVPARGSSSTFSNSSIATSVYSNQTTSTRLGSTAGSGTSVSSLPSTARTRSWVEDQNRNLSPFMRGAHNISFVTPPSSRSSSQGTVSTVPKEVLDSWTGAFNTRRQPLFAHIRKRGESRV

SEQ ID NO: 4321 - protein, 268 aa, Artificial Sequence; identical to SEQ ID NO: 4202
  capsid_protein_VP2__Norovirus__AGE89635

SEQ ID NO: 4322 - protein, 268 aa, Artificial Sequence
  capsid_protein_VP2__Norovirus__AGE89638
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPGRINPRTPTPARGSSSTSSNASTATSIHLNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4323 - protein, 268 aa, Artificial Sequence
  capsid_protein_VP2__Norovirus__AGE89641
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPGRINPRTPTPARGSSSTSSNVSTATSIYSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4324 - protein, 268 aa, Artificial Sequence
  capsid_protein_VP2__Norovirus__AGE89644
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGALPGRINPRTPTPARGSSSTSSNASTATSIHSNQTVSTRLGSTAGSGTNVSGLPSTARTRSWVEDQNRNLSPFMRGAHNISFVTPPSSRSSSQGTVSTVPKEVLDSWTGAFNTRRQPLFAHIRRRGESRV

SEQ ID NO: 4325 - protein, 268 aa, Artificial Sequence
  capsid_protein_VP2__Norovirus__AGE89647
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPGRINPRTPTPARGSSSISSNASTATSIHSNQTVSTRLGSTAGSGTNVSSFPSTARTRSWVEDQNRNLSPFMRGAHNISFVTPPSSRSSSQGTVSTVPKEVLDSWTGAFNTRRQPLFAHIRRRGESRV

SEQ ID NO: 4326 - protein, 268 aa, Artificial Sequence; identical to SEQ ID NO: 4300
  capsid_protein_VP2__Norovirus__AGE89650

SEQ ID NO: 4327 - protein, 268 aa, Artificial Sequence
  capsid_protein_VP2__Norovirus__AGE89653
MAGAFFAGLASDVLGSGLGSLINAGAGAINQKVEFENNRKLQQASFQFSSNLQQASFQHDKEMLQAQIEATKKLQQEMMRVKQAMLLEGGFSETDAARGAINAPMTKALDWSGTRYWAPDARTTTYNAGHFSTPQSSGALPGRANLRAAVPARGSSSTSSNSSTATSVYSNQTISTRLGSTAGSGTSVSSLPSTARTRSWVEDQNRNLSPFMRGAHNISFVTPPSSRPSSQGTVSTVPKEVLDSWTGAFNTRRQPLFAHIRKRGESRA

SEQ ID NO: 4328 - protein, 268 aa, Artificial Sequence; identical to SEQ ID NO: 4210
  capsid_protein_VP2__Norovirus__AGE89656

SEQ ID NO: 4329 - protein, 268 aa, Artificial Sequence
  capsid_protein_VP2__Norovirus__AGE89659
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPGRINPRIPTPARGSSSTSSNASTATSIYSNQTVSTRLGSAAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4330 - protein, 268 aa, Artificial Sequence
  capsid_protein_VP2__Norovirus__AGE89662
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPGRINPRTPTPARGSSNTSSNASTATSIHSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4331 - protein, 268 aa, Artificial Sequence; identical to SEQ ID NO: 4217
  capsid_protein_VP2__Norovirus__AGE89665

SEQ ID NO: 4332 - protein, 268 aa, Artificial Sequence; identical to SEQ ID NO: 4330
  capsid_protein_VP2__Norovirus__AGE89668

SEQ ID NO: 4333 - protein, 268 aa, Artificial Sequence
  capsid_protein_VP2__Norovirus__AGE89671
MAGAFFAGLASDVLGSGLGSLINAGAGAINQKIDFENNRKLQQASFQFSSNLQQASFQHDKEMLQAQIEATKKLQQEMMKVKQAMLLEGGFSETDAARGAISAPMTKVLDWSGTRYWAPDARTTTYNSGRFSTPQPSGTLPGRINPRTPTPARGSSSTSSNASTATSIHLNQTVSTRLGSTAGSGTNVSSLPSTARTRSWVEDQNRNLSPFMRGAHNISFVTPPSSRSSSQGTVSTVPKEILDSWAGAFNTRRQPLFAHIRRRGESRV

SEQ ID NO: 4334 - protein, 268 aa, Artificial Sequence; identical to SEQ ID NO: 4330
  capsid_protein_VP2__Norovirus__AGE89674

SEQ ID NO: 4335 - protein, 268 aa, Artificial Sequence
  capsid_protein_VP2__Norovirus__AGE99604
MAGAFFAGLASDVLSSGLGSLINAGAGAINQKIDFENNRKLQQASFQFSSNLQQASFQHDKEMLQAQIEATKKLQQELMKVKQTILLEGGFSETDAARGAINAPMTKALDWSGTRYWAPDARTTTYNAGRFSTPQPSGALPGRINPRTPIPARGSPSISSNASTATSIHSNQTASTRLGSTAGSGTNVSSLPSTARTRSWVEDQNRNLSPFMRGAHNISFVTPPSSRSSSQGTVSTVPKDVLDSWTGAFNTRRQPLFAHIRRRGESRV

SEQ ID NO: 4336 - protein, 268 aa, Artificial Sequence
  capsid_protein_VP2__Norovirus__AGE99607
MAGPFFAGLASDVLGSGLGSLISAGAGAINQKVEFENNRKLQQASFQFSSNLQQASFQHDKEMLQAQIEATQKLQQELMKVKQAVLLEGGFSTTDAARGAINAPMTKALDWSGTRYWAPDARITTYNAGRFSTPQPLGALPGRTNPRVPASARSSPSSLSNAPTATSVYSNQTASTRLGSSAGSGAGVSSLPSTARTRSWVEDQNKNLSPFMKGALNTSFVTPPSSRSSNQGTVSTVPKEILDSWTGAFNTRRQPLFAHIRKRGESRV

SEQ ID NO: 4337 - protein, 268 aa, Artificial Sequence
  capsid_protein_VP2__Norovirus__AGK36312
MAGAFFAGLASDVLGSGLGSLINAGAGAINQKIDFENNRELQQASFQFSSNLQQASFQHDKEMLQAQIEATKKLQQEMMKVKQAMLLEGGFSETDAARGAINAPMTKVLDWSGTRYWAPDARTTTYNAGRFSTPQPSGTLPGRINPRTPTPARGSSSASSNASTATSIYSNQTVSTRLGSTAGSGTNVSSLPSTARTRSWVEDQNRNLSPFMRGAHNISFVTPPSSRSSSQGTVSTVPKEVLDSWTGAFNTRRQPLFAHIRRRGESRV

SEQ ID NO: 4338 - protein, 268 aa, Artificial Sequence; identical to SEQ ID NO: 4309
  capsid_protein_VP2__Norovirus__AGK36315

SEQ ID NO: 4339 - protein, 212 aa, Artificial Sequence
  capsid_protein_VP2__Norovirus__AGM33209
MAQAIIGAIAASTAGSALGAGIQVGGEAALQSQRYQQNLQLQENSFKHDREMIGYQVEASNQLLAKNLATRYSLLRAGGLTSADAARSVAGAPVTRIVDWNGVRVSAPESSATTLRSGGFMSVPIPFASKQKQVQSSGISNPNYSPSSISRTTSWVESQNSSRFGNLSPYHAEALNTVWLTPPGSTASSTLSSVPRGYFNTDRLPLFANNRR

SEQ ID NO: 4340 - protein, 212 aa, Artificial Sequence
  capsid_protein_VP2__Norovirus__AGM33215
MAQAIIGAIAASTAGSALGAGIQVGGEAALQSQRYQQNLQLQENSFKHDREMIGYQVEASNQLLAKNLATRYSLLRAGGLTSADAARSVAGVPVTRIVDWNGVRVSAPESSATTLRSGGFMSVPIPFASKQKQVQSSGISNPNYSPSSISRTTSWVESQNSSRFGNLSPYHAEALNTVWLTPPGSTASSTLSSVPRGYFNTDRLPLFANNRR

SEQ ID NO: 4341 - protein, 212 aa, Artificial Sequence; identical to SEQ ID NO: 4339
  capsid_protein_VP2__Norovirus__AGM33218

SEQ ID NO: 4342 - protein, 212 aa, Artificial Sequence; identical to SEQ ID NO: 4339
  capsid_protein_VP2__Norovirus__AGM33221

SEQ ID NO: 4343 - protein, 212 aa, Artificial Sequence; identical to SEQ ID NO: 4340
  capsid_protein_VP2__Norovirus__AGM33224

SEQ ID NO: 4344 - protein, 212 aa, Artificial Sequence; identical to SEQ ID NO: 4339
  capsid_protein_VP2__Norovirus__AGM33227

SEQ ID NO: 4345 - protein, 212 aa, Artificial Sequence; identical to SEQ ID NO: 4340
  capsid_protein_VP2__Norovirus__AGM33230

SEQ ID NO: 4346 - protein, 212 aa, Artificial Sequence
  capsid_protein_VP2__Norovirus__AGM33233
MAQAIIGAIAASTAGSALGAGIQVGGEAALQSQRYQQNLQLQENSFKHDREMIGYQVEASNQLLAKNLATRYSLLRAGGLTSADAARSVAGVPVTRIVDWNGVRVSAPESSATTLRSGGFMSVPIPFASKQKQIQSSGISNPNYSPSSISRTTSWVESQNSSRFGNLSPYHAEALNTVWLTPPGSTASSTLSSVPRGYFNTDRLPLFANNRR

SEQ ID NO: 4347 - protein, 212 aa, Artificial Sequence; identical to SEQ ID NO: 4339
  capsid_protein_VP2__Norovirus__AGM33236

SEQ ID NO: 4348 - protein, 212 aa, Artificial Sequence; identical to SEQ ID NO: 4339
  capsid_protein_VP2__Norovirus__AGM33239

SEQ ID NO: 4349 - protein, 212 aa, Artificial Sequence; identical to SEQ ID NO: 4339
  capsid_protein_VP2__Norovirus__AGM33242

SEQ ID NO: 4350 - protein, 212 aa, Artificial Sequence; identical to SEQ ID NO: 4340
  capsid_protein_VP2__Norovirus__AGM33245

SEQ ID NO: 4351 - protein, 212 aa, Artificial Sequence; identical to SEQ ID NO: 4339
  capsid_protein_VP2__Norovirus__AGT17786

SEQ ID NO: 4352 - protein, 212 aa, Artificial Sequence; identical to SEQ ID NO: 4339
  capsid_protein_VP2__Norovirus__AGT17793

SEQ ID NO: 4353 - protein, 268 aa, Artificial Sequence
  capsid_protein_VP2__Norovirus__AGT17796
MAGAFFAGLASDVLGSGLGSLINAGAGAINQKVEFENNRKLQQASFQFSSNLQQASFQHDIEMLQAQIEATKKLQQEMMRAKQAMLLEGGFSETDAARGAINAPMTKTLDWSGTRYWAPDARTTTYNAGRFSTPQPSGAQPGRANLRATVPARGSSSTSSNSSIATSVYSNQTTSTRLGSTAGSGTSVSSLPSTARTRSWVEDQNRNLSPFMRGAHNISFVTPPSSRSSSQGTVSTVPKEVLDSWTGAFNTRRQPLFAHIRKRGESRV

SEQ ID NO: 4354 - protein, 268 aa, Artificial Sequence
  capsid_protein_VP2__Norovirus__AGT17799
MAGAFFAGLASDVLGSGLGSLINAGAGAINQKVEFENNRKLQQDSFQFSSNLQQASFQHDKEMLQAQIEATKKLQQEMMRVKQAMLLEGGFSETDAARGAINAPMTKVLDWSGTRYWAPGARTTTYNAGYFSTPQHSGALPGRANLRAVVPARGSSRVSSNSSTATSVYSNQTASTRLGSTAGSGTSVSSLPSTARTRSWVEDQNRNLSPFMRGAHNISFVTPPSSRSSSQGTVSTVPKEVLNSQAGVFNTRRQPLFAHIRRRGESRA

SEQ ID NO: 4355 - protein, 212 aa, Artificial Sequence; identical to SEQ ID NO: 4339
  capsid_protein_VP2__Norovirus__AGT17804

SEQ ID NO: 4356 - protein, 212 aa, Artificial Sequence; identical to SEQ ID NO: 4339
  capsid_protein_VP2__Norovirus__AGT17807

SEQ ID NO: 4357 - protein, 212 aa, Artificial Sequence; identical to SEQ ID NO: 4339
  capsid_protein_VP2__Norovirus__AGT17810

SEQ ID NO: 4358 - protein, 268 aa, Artificial Sequence
  capsid_protein_VP2__Norovirus__AGT17814
MAGAFFAGLASDVLGSGLGSLINAGAGAINQKVEFENNRKLQQASFQFSSNLQQASFQHDKEMLQSQIDATKKLQQEMMRVKQAMLLEGGFSETDAARGAINAPMTKVLDWSGTRYWAPDARTTTYNAGRFSTPQPSGAPPGRANLRAAVPARGSSSTSSNSSIATSMYSNQTTSTRLGSTAGSGTSVSSLPSSARTRSWVEDQNRNLSPFMRGAHNISFVTPPSSRSSSQGTVSTVPKEVLDSWTGAFNTRRQPLFAHIRRRGESRV

SEQ ID NO: 4359 - protein, 268 aa, Artificial Sequence
  capsid_protein_VP2__Norovirus__AGT17820
MAGAFFAGLASDVLGSGLGSLINAGAGAINQKVEFENNRKLQQASFQFSSNLQQASFQHDKEMLQAQIEATKKLQQEMMRAKQAMLLEGGFSETDAARGAINAPMTKTLDWSGTRYWAPDARTTTYSAGRFSTPQPSGALPGRANLRATVPARGSSSTSSNSSIATSVYSNQTTSTRLGSTAGSGTSVSSLPSTARTRSWVEDQNRNLSPFMRGAHNISFVTPPSSRSSSQGTVSTVPKEVLDSWTGAFNTRRQPLFAHIRKRGESRV

SEQ ID NO: 4360 - protein, 268 aa, Artificial Sequence
  capsid_protein_VP2__Norovirus__AGT17824
MAGAFFAGLASDVLGSGLGSLINAGAGAINQKVEFENNRKLQQDSFQFSSNLQQASFQHDKEMLQAQIEATKKLQQEMMRVKQAMLLEGGFSETDAARGAINAPMTKVLDWSGTRYWAPDARTTTYNAGHFSTPQHSGALPGRANLRATVPARGSSRASSNSSTATSVYSNQTTSTRLGSTAGSGTSVSSLPSTARTRSWVEDQNRNLSPFMRGAHNISFVTPPSSRSSSQGTVSTVPKEVLNSRTGAFNTRRQPLFAHIRRQGESRA

SEQ ID NO: 4361 - protein, 212 aa, Artificial Sequence; identical to SEQ ID NO: 4339
  capsid_protein_VP2__Norovirus__AGT17827

SEQ ID NO: 4362 - protein, 268 aa, Artificial Sequence
  capsid_protein_VP2__Norovirus__AGT17831
MAGAIIAGLASDVLSSGLGSLINAGAGVINQKVDFENNKQLQQNSFQFSSNLQQASFQHDKEMLQAQIEATKKLQQEMMGIKQAVLLKGGFSETDAARGAVNAPMTKVLDWSGTRYWAPNASTTTYNAGRFSTPQPSGALPGRTNLRTAAPARGSPSISSNASTATSVYSNQTVSTRLGTSAGSGTSVSSLPSTARTRSWVEDQNRNLSPFMRGAHNISFVTPPSSRSSSQGTVSTVPKEVLDSWTGAFNTRRQPLFAHIRKRGESRV

SEQ ID NO: 4363 - protein, 212 aa, Artificial Sequence; identical to SEQ ID NO: 4339
  capsid_protein_VP2__Norovirus__AGT17837

SEQ ID NO: 4364 - protein, 268 aa, Artificial Sequence
  capsid_protein_VP2__Norovirus__AGT17843
MAGAFFAGLASDVLGSGLGSLINAGAGAINQKVEFENNRKLQQDSFQFSSNLQQASFQHDKEMLQAQIEATKKLQQEMMRVKQAMLLEGGFSETDAARGAINAPMTKVLDWNGTRYWAPGARTTTYNAGHFSTPQHSGALPGRANLRAAVPARGSSRASSNSSTATSVYSNQTTSTRLGSTAGSGTSVSSLPSTARTRSWVEDQNRNLSPFMRGAHNISFVTPPSSRSSSQGTVSTVPKEVLNSQTGAFNTRRQPLFAHIRRRGESRA

SEQ ID NO: 4365 - protein, 268 aa, Artificial Sequence
  capsid_protein_VP2__Norovirus__AGX85887
MAGAFFAGLASDVLSSGLGSLINAGAGAINQTVEFENNRKLQQASFQFSSNLQQASFQHDKEMLQSQIDATKKLQQEMMRVKQAMLLEGGFSETDAARGAINAPMTKVLDWSGTRYWAPDARTTTYNAGRFSTPQSSGAPPGRANLRAAVPAQGSSSTSSNSSIATSMYSNQTTSTRLGSTAGSGTSVSSLPSSARTRSWVEDQNRNLSPFMRGAHNISFVTPPSSRSSSQGTVSTVPKEVLDSWTGAFNTRRQPLFAHIRRRGESRV

SEQ ID NO: 4366 - protein, 268 aa, Artificial Sequence
  capsid_protein_VP2__Norovirus__AGX85893
MAGAFFAGLASDVLGSGLGSLINAGAGAINQKVEFENNRKLQQDSFQFSSNLQQASFQHDKEMLQAQIEATKKLQQEMMRVKQAMLLEGGFSETDAARGAINAPMTKVLDWSGTRYWAPGARTTTYNAGYFSTPQHSGALPGRANLRAAVPARGSSRVSSNSSTATSVYSNQTASTRLGSTAGSGTSVSSLPSTARTRSWVEDQNRNLSPFMRGAHNISFVTPPSSRSSSQGTVSTVPKEVLNSQTGVFNTRRQPLFAHIRRRGESRA

SEQ ID NO: 4367 - protein, 268 aa, Artificial Sequence
  capsid_protein_VP2__Norovirus__AGX85896
MAGAFFAGLASDVLGSGLGSLINAGAGAINQKVEFENNRKLQQDSFQFSSNLQQASFQHDKEMLQAQIEATKKLQQEMMRVKQAMLLEGGFSETDAARGAINAPMTKVLDWSGTRYWAPGARTTTYNAGYFSTPQHSGALPGRANLRAAVPARGSSRVSSNSSTATSVYSNQTASTRLGSTAGSGTSVSSLPSTARTRSWVEDQNRNLSPFMRGAHNISFVTPPSSRSSSQGTVSTVPKEVLNSQTGAFNTRRQPLFAHIRRRGESRA

SEQ ID NO: 4368 - protein, 268 aa, Artificial Sequence
  capsid_protein_VP2__Norovirus__AGX85905
MAGAFFAGLASDVLSSGLGSLINAGAGAINQRIDFENNRKLQQASFQFSSNLQQASFQHDKEMLQAQIEATKKLQQELMKVKQAMLLEGGFSETDAARGAINAPMTKALDWSGTRYWAPDARTTTYNAGRFSTPQPSGALPGRINPRTPIPARGSPSISSNVSTANSIHSNQTASTRLGSTAGSGTDVSSLPSTARTRSWVEDQNRNLSPFMRGAHNISFVTPPSSRSSSQGTVSTVPKDVLDSWTGAFNTRRQPLFAHIRRRGESRV

SEQ ID NO: 4369 - protein, 268 aa, Artificial Sequence
  capsid_protein_VP2__Norovirus__AGX85914
MAGAFFAGLASDVLGSGLGSLINAGAGAINQKVEFENNRKLQQDSFQFSSNLQQASFQHDKEMLQAQIEATKKLQQEMMRVKQAMLLEGGFSETDAARGAINAPMTKVLDWSGTRYWAPGARTTTYNAGYFSTPQHSGALPGRANLRAVVPARGSSRVSSNSSTATSVYSNQTASTRLGSTAGSGTSVSSLPSTARTRSWVEDQNRNLSPFMRGAHNISFVTPPSSRSSSQGTVSTVPKEVLNSQTGVFNTRRQPLFAHIRRRGESRA

SEQ ID NO: 4370 - protein, 268 aa, Artificial Sequence; identical to SEQ ID NO: 4365
  capsid_protein_VP2__Norovirus__AGX85917

SEQ ID NO: 4371 - protein, 268 aa, Artificial Sequence; identical to SEQ ID NO: 4362
  capsid_protein_VP2__Norovirus__AGX85923

SEQ ID NO: 4372 - protein, 268 aa, Artificial Sequence
  capsid_protein_VP2__Norovirus__AGX85926
MAGAIIAGLASDVLSSGLGSLINAGAGAINQTIDFENNRKLQQASFQFSSNLQQASFQHDKEMLQAQIEATKKLQQEMMRVKQAMLLEGGFSETDAARGAINAPMTKTLDWSGTRYWAPDARTTTYNAGRFSTPQPSGAPPGRANLRATTPARGSSSTSSNSSIATSVYSNQTTSTRLGSTAGSGTSVSSLPSTARTRSWVEDQNRNLSPFMRGAHNISFVTPPSSRSSSQGTVSTVPKEVLDSWTGAFNTRRQPLFAHIRTRGESRV

SEQ ID NO: 4373 - protein, 268 aa, Artificial Sequence; identical to SEQ ID NO: 4369
  capsid_protein_VP2__Norovirus__AGX85932

SEQ ID NO: 4374 - protein, 268 aa, Artificial Sequence; identical to SEQ ID NO: 4369
  capsid_protein_VP2__Norovirus__AGX85935

SEQ ID NO: 4375 - protein, 259 aa, Artificial Sequence
  capsid_protein_VP2__Norovirus__AHI59155
MASAFLAGLAGDVITNGVGSLINAGANAVNQKVEYDFNKQLQMASFKHDKEMLQSQVLATKQLQQEMMNIRQGVLTAGGFSPADAARGAVNAPMTKILDWNGTRYWAPNSMKTTSYSGQFSSSPVHKSPAPSQHTALPKSRLQNDFASVYSFPSSVSSQSTHSTALSAGTGSSRSISPSTATPTLSRTSDWVRGQNERLSPFMDGALQTAFVTPPSSKASSNGTVSTVPKAVLDSWTPMFNTHRQPLFAHPRRRGESQV

SEQ ID NO: 4376 - protein, 268 aa, Artificial Sequence
  capsid_protein_VP2__Norovirus__AHI59158
MAGAFFAGLASDVLGSGLGSLINAGAGAINQKVEFENNRKLQQASFQFSSNLQQASFQHDKEMLQAQIEATKKLQQEMMRVKQAMLLEGGFSETDAARGAINAPMTKTLDWSGTRYWAPDARTTTYNAGRFSTPQPSGALPGRANLRATVPARGSSNTSSSSSIATSVYSNQTTSTRLGSTAGSGTSVSSLPSTARTRSWVEDQNRNLSPFMRGAHNISFVTPPSSRSSSQGTVSTVPKEVLDSWTGAFNTRRQPLFAHIRKRGESRV

SEQ ID NO: 4377 - protein, 259 aa, Artificial Sequence
  capsid_protein_VP2__Norovirus__AHI59160
MAGAFVAGLAGDVLSNGLSSLINAGANAINQRAEFDFNQKLQQNSFNHDKEMLQAQIQATKQLQADMMAIKQGVLTAGGFSPADAARGAVNAPMTQALDWNGTRYWAPGSMRTTSYSGKFTSTAPVRQADFQHTQSRPSSGSSVSSFATQSSRPTLTTTTGSSHGTASSNSTRSTSLSQSTVSRATSRTSEWVRDQNRNLEPYMHGALQTAFVTPPSSRASDGTVSTVPKGVLDSWTPAFNTRRQPLFAHLRKRGESHA

SEQ ID NO: 4378 - protein, 268 aa, Artificial Sequence
  capsid_protein_VP2__Norovirus__AHI59163
MAGAFFAGLASDVLGSGLGSLINAGAGAINQKVEFENNRKLQQASFQFSSNLQQASFQHDKEMLQAQIEATKKLQQEMMRVKQAMLLEGGFSETDAARGAINAPMTKTLDWSGTRYWAPDARITTYNAGRFPTPQLSGALPGRANLRATVPARGSPSTSSNSSIATSVYSNQTTSTRLGSTAGSGTSVSSLPSTARTRSWVEDQNRNLSPFLRGAHNISFVTPPSSRSSSQGTVSTVPKEVLDSWTGAFNTRRQPLFAHIRKRGESRV

SEQ ID NO: 4379 - protein, 268 aa, Artificial Sequence
  capsid_protein_VP2__Norovirus__AHI59166
MAGAFFAGLASDVLGSGLGSLINAGAGAINQKVEFENNRKLQQASFQFSSNLQQASFQHDKEMLQAQIEATKKLQQGMMKVKQAMLLEGGFSETDAARGAINAPMTKALDWSGTRYWAPDARTTTYNAGRFSTPQPSGALPGRNNLRATVPARGSSSTLSSIPTATSVYSNQTVSTRLGSSAGSGTSVSSLPSTARTRSWVEDQNKNLSPFMRGALNTSFVTPPSSRSSSQGTVSTVPKEILDSWTGAFNTRRQPLFAHVRKRGESRV

SEQ ID NO: 4380 - protein, 268 aa, Artificial Sequence
  capsid_protein_VP2__Norovirus__AHX22026
MAGAFFAGLASDVLGSGLGSLINAGAGAINQKVEFENNRKLQQASFQFSSNLQQASFQHDKEMLQAQIEATKKLQQEMMRVKQVMLLEGGFSETDAARGAINAPMTKALDWSGTRYWAPDARTTTYNAGRFSTPQPSGALPGRANLRVTAPARGSSSTSSNSSIATSVYSSQTTSTRLGSTAGSGTSVSSLPSTARTRSWVEDQNRNLSPFMRGAHNISFVTPPSSRSSSQGTVSTVPKEVLDSWTGAFNTRRQPLFAHIRKRGESRV

SEQ ID NO: 4381 - protein, 268 aa, Artificial Sequence
  capsid_protein_VP2__Norovirus__AHX22029
MAGAFFAGLASDVLGSGLGSLINAGAGAINQKVEFENNRKLQQASFQFSSNLQQASFQHDKEMLQAQIEATKKLQQEMMKVKQVMLLEGGFSETDAARGAINAPMTKALDWSGTRYWAPDARTTTYNAGRFSTPQPSGVLPGRANLRDAVPARGSSSKSSNSFTATSVYSNQTTSTRLGSTAGSGTSVSSLPSTARTRSWVEDQSRNVSPFMRGAHNISFVTPPSSRSSSQGTVSTVPKEVLDSWTGAFNTRRQPLFAHIRKRGESRV

SEQ ID NO: 4382 - protein, 268 aa, Artificial Sequence
  capsid_protein_VP2__Norovirus__AHX22033
MAGAFFAGLASDVLGSGLGSLINAGAGAINQKVEFENNRKLQQASFQFSSNLQQASFQHDKEMLQAQIEATKKLQQEMMRVKQVMLLEGGFSETDAARGAINAPMTKALDWSGTRYWAPDARTTTYNAGRFSTPQPSGALSGRANLRATAPARGSSSTSSNSSIATSVYSNQTTSTRLGSTAGSGTSVSSPPSTARTRSWVEDQNRNLSPFMRGAHNISFVTPPSSRSSSQGTVSTVPKEVLDSWTGAFNTRRQPLFAHIRKRGESRV

SEQ ID NO: 4383 - protein, 268 aa, Artificial Sequence
  capsid_protein_VP2__Norovirus__AHX22036
MAGAFFAGLASDVLGSGLGSLINAGAGAINQKVEFENNRKLQQASFQFSSNLQQASFQHDKEMLQAQIEATKKLQQEMMRVKQAMLLEGGFSETDAARGAINAPMTKTLDWSGTRYWAPDARTTTYNAGRFSTPQPSGALPGRASLRATVPARGSSSMSSNSSIATSVYSNQTTSTRLGSTAGSGTSVSSLPSTARTRSWVEDQNRNLSPFMRGAHNISFVTPPSSISSSQGTVSTVPKEVLDSWTGAFNTRRQPLFAHIRKRGESRV

SEQ ID NO: 4384 - protein, 268 aa, Artificial Sequence
  capsid_protein_VP2__Norovirus__AHX22039
MAGAFFAGLASDVLGSGLGSLINAGAGAINQKVEFENNRKLQQASFQFSSNLQQASFQHDKEMLQAQIEATKKLQQEMMKVKQAMLLEGGFSETDAARGAINAPMTKALDWSGTRYWAPDARTTTYNAGRFSTPQPSGALPGRANLRDAVPARGSSSKSSNSSTATSVYSNQTTSTRLGSTAGSGTSVSSLPSTARTRSWVEDQSRNLSPFMRGAHNISFVTPPSSRSSSQGTVSTVPKEVLDSWTGAFNTRRQPLFAHIRKRGESRV

SEQ ID NO: 4385 - protein, 268 aa, Artificial Sequence
  capsid_protein_VP2__Norovirus__AHX22042
MAGAFFAGLASDVLGSGLGSLINAGAGAINQKVEFENNRKLQQASFQFSSNLQQASFQHDKEMLQAQIEATKKLQQEMMKVKQAMLLEGGFSETDAARGAINAPMTKALDWSGTRYWAPDARTTTYNAGRFSTPQPSGVLPGRANLRDAVPARGSSSKSSNSFTATSVYSNQTTSTRLGSTAGSGTSVSSLPSTARTRSWVEDQSRNLSPFMRGAHNISFVTPPSSRSSSQGTVSTVPKEVLDSWTGAFNTRRQPLFAHIRKRGESRV

SEQ ID NO: 4386 - protein, 268 aa, Artificial Sequence
  capsid_protein_VP2__Norovirus__AHX22048
MAGAFFAGLASDVLGSGLSSLINAGAGAINQKVEFENNRKLQQASFQFSSNLQQASFQHDKEMLQAQIEATKKLQQEMMRVKQAMLLEGGFSETDAARGAINAPMTKALDWSGTRYWAPDARTTTYNAGRFSTPQPSGALPGRANLRAAVPARGSSSMSSNSSTATSVYSNQTTSTRLGSTAGSGTSVSSLPSTARIRSWVEDQNRNLSPFMRGAHNISFVTPPSSRSSSQGTVSTVPKEVLDSWTGAFNTRRQPLFAHIRKRGESRA

SEQ ID NO: 4387 - protein, 268 aa, Artificial Sequence; identical to SEQ ID NO: 4383
  capsid_protein_VP2__Norovirus__AHX22051

SEQ ID NO: 4388 - protein, 268 aa, Artificial Sequence
  capsid_protein_VP2__Norovirus__AHX22055
MAGAFFAGLASDVLGSGLSSLINAGAGAINQKVEYENNRKLQQASFQFSSNLQQASFQHDKEMLQAQIEATKKLQQEMMRVKQAMLLEGGFSETDAARGAINAPMTKTLDWSGTRYWAPDARTTTYNAGRFSTPQPSGALPGRANLRATVPARGSSSTSSNSSIATSVYSNQTTLTRLGSTAGSGTSVSSLPSTARTRSWVEDQNRNLSPFMRGAHNISFVTPPSSRSSSQGTVSTVPKEVLDSWTGAFNTRRQPLFAHIRKRGESRV

SEQ ID NO: 4389 - protein, 230 aa, Artificial Sequence
  capsid_protein_VP2__Norovirus__AII02849
MAGAFIAGLAGDMLTNTVGSLVNAGANAINQTIDFENNKYLQNASFNHDKEMLNAQIEATKRLQADMIAIKQGVLTAGGFSPTDAARGAINAPMTKVLDWNGTRYWAPGATSTTSMSGGFINQTVHRSTPNFKTNQAPKPAPSSGSSVRSNSTQITSLSSHSSGSSRSSGSTVVSSIPSSNRTRDWVNQQNFNLEPHMPGSLRTAFVTPPSSTASSSGTVSTVPKNVLDS

SEQ ID NO: 4390 - protein, 267 aa, Artificial Sequence
  capsid_protein_VP2__Norovirus__AKE07101
MAGAFFAGLASDVLGSGLGSLINAGAGAINQKVEFENNRKLQQASFQFSSNLQQASFQHDKEMLQAQIEATKKLQQEMMKVKQAVLLEGGFSETDAARGAINAPMTKALDWSGTRYWAPDARTTTYNAGHFSTPQPSGAPLGRANLRAAVPTRGSSSTSSNSSIATSVYSNQTASTRLGSTAGSGASVSSLPSTARTRSWVEDQRNLSPFMRGAHNISFVTPPSSRSSSQGTVSTVPKEVLDSWTGAFNTRRQPLFAHIRKRGESRV

SEQ ID NO: 4391 - protein, 268 aa, Artificial Sequence
  capsid_protein_VP2__Norovirus__AKE07104
MAGAFFAGLASDVLGSGLGSLINAGAGAINQKVEFENNRKLQQASFQFSSNLQQASFQHDKEMLQAQIEATKKLQQEMMKVKQAVLLEGGFSETDAARGAINAPMTKALDWSGTRYWAPDARTTTYNAGRFSTPQPSGILPGRANLRDTVPARGSSSTSSKSSIATSLYSNQTATTRLGSTAGSGTSVSSLPSTARTRSWVEDQNRNLSPFMRGAHNISFVTPPSSRSSSQGTVSTVPKEVLDSWTGAFNTRRQPLFAHIRKRGESRV

SEQ ID NO: 4392 - protein, 268 aa, Artificial Sequence
  capsid_protein_VP2__Norovirus__AKE07107
MAGAFFAGLASDVLGSGLGSLINAGAGAINQKVEFENNRKLQQASFQFSSNLQQASFQHDKDMLQAQIEATKKLQQEMMRVKQAMLLEGGFSETDAARGAINAPMTKALDWSGTRYWAPDARTTTYNAGHFSTPQPSGALPGRANLRAAVPARGPSSTSSNSSTATSVYSNQTTSTRLGSTAGSGASVSSLPSTARTVNWVRDQNRSLSPFMRGAHNTSFVTPPSSRSSSQGTVSTVPKEVLDSWTGAFNTRRQPLFAHIRTRGESRV

SEQ ID NO: 4393 - protein, 254 aa, Artificial Sequence
  capsid_protein_VP2__Norovirus__ALE30634
MAGAFIAGLAGDMLTNTVGSLVNAGAGAINQKVDFENNKYLQNASFNHDKEMLNAQIEATKRLQADMIAIKQGVLTAGGFSPTDAARGAINAPITKVLDWSGTRYWAPNATSTTSMSGGFTGQAVHRATPNFKTNQAPKSTPSSGSSVRSSSTQLTNLSSHSSGSSRSSGSTMVSSLPSSSRTRDWVNQQNFNLEPHMPGSLRTAFVTPPSSTASSLDTVSTVPKSVLDSWTPAFNTRRQPLFAHLRRRGESNI

SEQ ID NO: 4394 - protein, 254 aa, Artificial Sequence
  capsid_protein_VP2__Norovirus__ALE30636
MAGAFIAGLAGDMLTNTVGSLVNAGAGAINQKVDFENNKYLQNASFNHDKEMLNAQIEATKRLQADMIAIKQGVLTAGGFSPTDAARGAINAPITKVLDWSGTRYWAPNATSTTSMSGGFTGQAVHRATPNFKTNQAPKSTPSSGSSVRSSSTQLTNLSSHSSGSSRSSGSTMVSSLPSSSRTRDWVNQQNFNLEPHMPGSLRTAFVTPPSSTASSLDTVSTVPKSVLDSWTSAFNTHRQPLFAHLRKRGESNV

SEQ ID NO: 4395 - protein, 259 aa, Artificial Sequence
  capsid_protein_VP2__Norovirus__BAR42290
MAGAFIAGLAGDMLTSSVGSLVNAGANAINQKIDFENNKQLQSASFQHDKEMLQAQVRATKQLQSEMIALKQGVLAAGGFSPTDAARGSIGAPMTKVLDWSGTRYWAPNSTKTTGYSGQFTSSPVHMSSPNAPQSKPAKPRSLAPSSSSSSVYSMYTQSTHLTSGSSSNASSASTKLTSLSSGSSQNRTAEWVNQQRSLSPFMSGALNISHVTPPSSRASSSGTVSTVPKEVLDSWTSAFNTHRQPLFAHLRVRGESRV

SEQ ID NO: 4396 - protein, 259 aa, Artificial Sequence
  capsid_protein_VP2__Norovirus__BAR47617
MAGAFIAGLAGDMLTSSVGSLVNAGANAINQKIDFENNKQLQSASFQHDKEMLQAQVKATKQLQSEMIALKQGVLAAGGFSPTDAARGAIGAPMTKVLDWSGTRYWAPNSTKTTGYSGQFTSSPVHMPSPNAPQSKPAKPRSLAPSSSSSSVYSMSTQSTHLTSGSSSNASSASTKLTNLSSGSSQNRTAEWVNQQRSLSPFMSGALNISHVTPPSSRASSSGTVSTVPKEVLDSWTSAFNTHRQPLFAHLRVRGESRV

SEQ ID NO: 4397 - protein, 259 aa, Artificial Sequence
  capsid_protein_VP2__Norovirus__BAR63716
MAGAFIAGLAGDMLTSSVGSLVNAGANAINQKIDFENNKQLQSASFQHDKEMLQAQVKATKQLQSEMIALKQGVLAAGGFSPTDAARGAIGAPMTKVLDWSGTRYWAPNSTKTTGYSGQFTSSPVRMPSPNAPQSKPAKPRSLAPSSSSSSVYSMSTQSTHLTSGSSSNASSASTKLTNLSSGSSQNRTAEWVNQQRSLSPFMSGALNISHVTPPSSRASSSGTVSTVPKEVLDSWTSAFNTHRQPLFAHLRVRGESRV

SEQ ID NO: 4398 - protein, 259 aa, Artificial Sequence; identical to SEQ ID NO: 4396
  capsid_protein_VP2__Norovirus__BAR63719

SEQ ID NO: 4399 - protein, 259 aa, Artificial Sequence; identical to SEQ ID NO: 4396
  capsid_protein_VP2__Norovirus__BAR63722

SEQ ID NO: 4400 - protein, 268 aa, Artificial Sequence
  capsid_protein_VP2__Norovirus__BAS02084
MAGAFFAGLASDVLGSGLGSLINAGAGAINQKVEFENNRKLQQASFQFSSNLQQASFQHDKEMLQAQIEATKRLQQEMMKVKQAMLLEGGFSETDAARGAINAPMTKALDWNGTRYWAPDARTTTYNAGRFSTPQPSGALPGRANLRDAVPARGSSSKSSNSSTATSVYSNQTISTRLGSTAGSGTSVSSFPSTARTRSWVEDQSRNLSPFMRGAHNISFVTPPSSRSSSQGTVSTVPREILDSWTGAFNTRRQPLFAHIRKRGESRV

SEQ ID NO: 4401 - protein, 208 aa, Artificial Sequence
  capsid_protein_VP2__Norovirus__CRL46953
MAQAIIGAIAASAAGSALGAGIQAGAEAALQAQRYQQDLTLQQNSFNHDKEMLGYQVEMSNKLLAKNLNTRYSLLQAGGLSPSDAARAVAGAPVTRLVDWGGVRVAAPQSSATTLRSGNFMAVPLPAQPKQKPLASEGYSNPAYDPMQRTASWVQSQNSSRNWSPYHRQALQTVWVTPPGSTSSSSVSTAPRGYFNTDRLPLFANLRR

SEQ ID NO: 4402 - protein, 209 aa, Artificial Sequence
  capsid_protein_VP2__Norovirus__CRL46956
MAQAVIGAIAASAAGSILGAGIQAGAEAGLQAQRYQQDLQLQQNSFKHDKEMLGYQVQASNALLAKNLNTRYALLQAGGLSSADAARAVAGAPVTRIVDWNGTRIAAPASSATTLRSGGFMAVPIPLSSKTKQPVMSGQDNPNYAASSISRTASWVQSQNSMRSVSPFHSDALRTVWVTPPGSSSTSSVQSSFYGVFNTDRLPLFANRR

SEQ ID NO: 4403 - protein, 268 aa, Artificial Sequence
  capsid_protein_VP2__Norovirus__CRL46959
MAGAFFAGLASDVLGSGLSSLINAGAGAINQKIDFENNRKLQQASFQFSSNLQQASFQHDKEMLQAQVEATKKLQQEMMKVKQAILLEGGFSATDAARGAINAPMTKVLDWNGTRYWAPDARTTTYNTGHFSTPQSSGALPGRTNPRIPTPARASSSTSSNASTATSISSNQTVSTRLGSTAGSGTNVSSLPSTARTRSWVEDQNRNLSPFMRGAHNISFVTPPSSRSSSQGTVSTVPKGVLDSWTGAFNTRRQPLFAYTHRRGESRV

SEQ ID NO: 4404 - protein, 268 aa, Artificial Sequence
  capsid_protein_VP2__Norovirus__CRL46962
MAGAFFAGLASDVLGSGLGSLINAGAGAINQKVEFENNRKLQQASFQFSSNLQQASFQHDKEMLQAQIEATKKLQQEMMKVKQAMLLEGGFSETDAARGAINAPMTKALDWSGTRYWAPDARTTTYNAGRFSTPQPSGALPGRANLRDAVPARGPSSKFSNSSTATSVYSNQTISTRLGSTAGSGTSVSSLPSTARTRSWVEDQSRNLSPFMGGAHNISFVTPPSSRSSSQGTVSTVPKEILDSWTGAFNTRRQPLFAHIRKRGESRV

SEQ ID NO: 4405 - protein, 268 aa, Artificial Sequence
  capsid_protein_VP2__Norovirus__CRL46965
MAGAFFAGLASDVLGSGLGSLINAGAGAINQKVEFENNRKLQQASFQFSSNLQQASFQHDKEMLQAQIEATKKLQQEMMKVKQAVLLEGGFSETDAARGAINAPMTKALDWSGTRYWAPDARTTTYNAGRFSTPQPSGALPGRANLRDAAPARGSSSKSSNSFTATSVYSNQTTSTRLGSTAGSGTSVSSLPSTARTRSWVEDQSRNLSPFMRGAHNISFVTPPSSRSSSQGTVSTVPKEVLDSWTGAFNTRRQPLFAHIRRRGESRV

SEQ ID NO: 4406 - protein, 258 aa, Artificial Sequence
  capsid_protein_VP2__Norovirus__CRL46968
MAGAFLAGLVGDAITSGVGSLINAGANAINQKVEYDFNKQLQLASFKHDKEMLQSQVLATKQLQQEMMNIRQGVLSAGGFSPTDAARGAVNAPMTKILDWNGTRYFAPNSMKTTSYSGQFSSNPVHRQPTSPRSDPPKIKVNSDSASVYSSASSAPSQSTHSTALTAGSSSSRTTSSSAAASTLSRTSDWVRGQNERLSPFMDGALQTTFVTPPSSKASSYGSVSTVPKAVLDSWTPMFNTHRQPLFAHVRRRGESQI

SEQ ID NO: 4407 - protein, 254 aa, Artificial Sequence
  capsid_protein_VP2__Norovirus__CRL46971
MAGAFIAGLAGDMLTNTVGSLVNAGANAINQTIDLENNKYLQNASFNHDKEMLNAQIEATKKLQADMIAIKQGVLTAGGFSPTDAARGAINAPMTKVLDWNGTRHWAPGATSTTSMSGGFTHQTVHRSTPNFKTNQAPKSTPSSGSSVRSNSTQITSLSSHSSGSSRSSGSTVIRSIPSSDRTRDWVNQQNFNLEPHMPGSLRTAFVTPPSSTASSSGTVSTVPKNVLDSWTSAFNTRRQPLFAHLRRRGESNV

SEQ ID NO: 4408 - protein, 256 aa, Artificial Sequence
  capsid_protein_VP2__Norovirus__CRL46974
MAGAFVAGLAGDIVTNSIGSLVNAGANAINQKVDFENNKQLQQASFNHDQEMLQAQIQATKQLQADMIALRQGVLTAGGFSPTDAARGAVNAPMTQVLDWSGTRYWAPGATKTTAFSGGFTSSPNTRTIVPKKTSATPASTSVSRPSSLASTASTRSTFVSGTSSLSSSTRSSFNSQPTSSSSRTSEWVRSQNRVLEPYMRGSLQTAFVTPPSSRASSNGTVSTVPKEVLDSWTSVFNTHRQPLFAHLRRRGESQV

SEQ ID NO: 4409 - protein, 268 aa, Artificial Sequence
  capsid_protein_VP2__Norovirus__CRL46977
MAGAFFAGLASDVLGSGLGSLINAGAGAINQKVEFENNRKLQQASFQFSSSLQQASFQHDKEMLQAQIEATKKLQQEMMRVKQAMLLEGGFSETDAARGAINAPMTKTLDWSGTRYWAPDARTTTYNAGRFSTPQPSGALPGRANLRATAPARGSSSMSSNSSIATSVYSNQTTSTRLGSTAGSGTSVSSLPSTARTRSWVEDQNRNLSPFMRGAHNISFVTPPSSRSSSQGTVSTVPKEVLDSWTGAFNTRRQPLFAHIRKRGESRA

SEQ ID NO: 4410 - protein, 268 aa, Artificial Sequence
  capsid_protein_VP2__Norovirus__CRL46980
MAGAFLAGLASDVLGSGLGSLINAGAGAINQKVEFENNRKLQQASFQFSSSLQQASFQHDKEMLQAQIEATKKLQQEMMRVKQAMLLEGGFSETDAARGAINAPMTKTLDWSGTRYWAPDARTTTYNAGRFSTPQPSGALPGRANLRATAPARGSSSMSSNSSIATSVYSNQTTSTRLGSTAGSGTSVSSLPSTARTRSWVEDQNRNLSPFMRGAHNISFVTPPSSRSSSQGTVSTVPKEVLDSWTGAFNTRRQPLFAHIRKRGESRA

SEQ ID NO: 4411 - RNA, 1623 nt, Artificial Sequence
  capsid_protein_VP1__Norovirus__ABY65350
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacaguuuacacugggagugcccccuuuacuccaaagcugggcaguguucaauccaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuucccggugaacaacuucuuuucuuuagguccacugugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuauguuacaguggcucacaccggccagcaugauuuggucaucccccccaaugguuauuuuagguuugauuccuggguuaaucaauucuacacacuugcccccaugggaaaugggacggggcguagacgugcuuuauaa

SEQ ID NO: 4412 - RNA, 1623 nt, Artificial Sequence
  capsid_protein_VP1__Norovirus__ACO55068
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuaggaacgcuccaggugaaauacuauggagcgcgcccuuggguccugaucugaaccccuaccuuucucauuuggccagaauguacaauggcuaugcagguggcuuugaagugcagguaauucuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaauaauuucuaucacuacaaccaaucaaaugaccccaccauuaaacugauagcaaugcuguacacaccacuuagggcuaauaaugcuggggaagaugucuucacagucucuugucgaguccucacgaggccaucccccgauuuugauuucauauuucuggugccacccacaguugagucaagaacuaagccauucaccgucccaauuuuaacuguugaggaaaugaccaauucaagauuccccauuccuuuggaaaaguuguucacgggucccagcggugccuuuguuguucaaccacaaaauggcaggugcacgacugauggcgugcucuuaggcacuacccaacugucuccugucaacaucugcaccuucagaggggaugucacccacauugcagguacucauaauuacacaaugaauuuggcuucucaaaauuggaacaauuaugacccagcagaagaaaucccagccccucuggggaccccagauuuugugggaaggauccaaggugugcucacccaaacuacaaggggggauggcucuacccgcggccacaaagcuacagugagcacuggggacguccauuucacuccaaagcugggcaguauucaguucaacacugacacaaauaaugauuuugaaacuggccaaaacacgaaauucaccccagucgguguuguccaggaugguaauggcacccaccaaaaugaaccccagcaaugggugcucccaagcuacucagguagaacuggucacaauguacaccuagcccccgccguagcccccacuuuuccgggugagcaacuucuuuucuucagguccacuaugcccggaugcagcggguaccccaacaugaauuuggauugucuacucccccaggaaugggugcaacacuucuaccaagaagcagcaccagcacaaucugauguggcucugcuaagauuugugaauccagacacagguaggguucuauuugagugcaagcuucauaaaucaggcuaugucacgguggcucacacuggccagcaugauuugguuaucccccccaauggcuacuuuagauuugauuccugggucaaccaguucuacacacuugcccccaugggaaaugggacggggcguagacgugcauuauaa

SEQ ID NO: 4413 - RNA, 1623 nt, Artificial Sequence
  capsid_protein_VP1__Norovirus__ADI45808
augaagauggcgucgaaugacgccaacccaucugauggguccacagccaaccucgucccagaggucaacaaugaggucauggcuuuggagcccguugugggugccgcuauugcggcaccuguagcgggccaacaaaauguaauugaccccuggauuagaaauaauuuuguacaagccccugguggagaguucacaguguccccuagaaaugcuccaggugagauauuauggagcgcacccuuagguccugauuugaauccuuaccuuucccauuuggccagaauguacaaugguuaugcaggugguuuugaagugcagguaauccuugcggggaacgcguucaccgccggaaaaaucauauuugcagcagucccaccgaacuuuccaacugaaggccuuagucccagucagguuacuauguucccccguauaauaguagauguuaggcaauuggaaccuguguugauccccuuaccugauguuaggaacaauuucuaucacuacaaccaaucaaaugaccccaccauuaaguugauagcaaugcuguauacaccacucagggcuaauaaugcuggggaugaugucuucacagucucuugucgaguccuuacgaggccauccccugauuuugauuucauauuucuggugccaccaacaguugaaucaagaacuaaaccauucacugucccaaucuuaacuguugaggaaaugaccaauucaagauuccccaucccuuuggaaagguuguacacgggucccagcagugcuuuuguuguccagccacaaaacggcagaugcacgacugauggcgugcucuuaggcaccacccagcugucugcuguuaacaucugcaccuuuagaggagaugucacccacauugcaggcucucgcaauuacacaaugaaucuggccucucaaaauuggaacaacuaugacccaacagaagaaaucccagccccccugggaaccccagacuucgugggaaagauccaaggcaugcucacccaaaccacaagaagugauggcuccacccguggccacaaagccacagugcucacugggagugccgacuuugccccaaaacugggcagaguccaauucgccacugacacggacaaugauuuugaauccggccaaaauacgaaauucaccccagucggcgucauccaggaugguuccacaacccaccgaaaugaaccccaacaauggguacucccaaauuacucagguagaacuggucacaauguacaccuagccccugccguugcccccacuuacccgggugagcaacuccuuuucuucagguccacuaugcccggguguagcggguaucccaacauggaucuagacugcuugaucccccaggauugggugcaacacuucuaccaggaagcagccccagcacaaucugauguggcucugcuaagguuugugaauccagacacagguaggguuuuguuugagugcaagcuccauaaaucaggauaugucacaguggcucauacuggucagcaugauuuaguuauuccccccaaugguuauuuuagauuugauucuugggucaaccaguuuuacacacuugcccccaugggaaaugggacggggcguagacgugcauuauaa

SEQ ID NO: 4414 - RNA, 1623 nt, Artificial Sequence
  capsid_protein_VP1__Norovirus__ADI45811
augaagauggcgucgagugacgccaacccaucugauggguccacagccaaccucgucccagaggucaacaaugagguuauggcuuuggagcccguuguuggugccgccauugcggcaccuguggcgggccaacaaaauguaauugaccccuggauuagaaacaauuuuguacaagccccugguggagaguucacaguauccccuaggaacgcuccaggugaaauaccauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcaguuccaccaaacuucccaacugaaggcuugagccccagccaggucacuauguucccccacauaauaguagauguuaggcaauuggaaccuguguugauccccuuacccgauguuaggaauaauuucuaucacuacaaucaaucaaaugaccccaccaucaaauugauagcaauguuguauacaccacuuagggcuaauaaugcuggagacgaugucuucacaguuucuugucggguucucacgagaccaucccccgauuuugauuucauauuuuuaguaccacccacaguugagucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgacugauggcgugcuccuagguaccacucaacugucuccugucaacaucugcaccuucagaggggaugucacccauauuacagguagucgaaacuacacaaugaauuuggcuacucaaaauuggaacaguuaugacccaacagaagaaaucccagccccucuaggaacuccagauuucguggggaagauucaaggugugcucacccaaaccacaagggcagauggcucgacccgcggccacaaagcuacaguauacacugggagcgccgauuuugcuccaaaacuggguagaguucaauuugccacugacacagacaaugauuuugaugcuaaccaaaacacaaaguucaccccagucggugucauccaggauggugauacugcccaccgaaaugaaccccaacaaugggugcucccaaguuacucaggcagaaauagucacaaugugcaccuggcccccgcuguagcccccacuuuuccgggugagcaacuucucuucuucagauccacuaugcccggauguagcggguaccccaauauggauuuggacugucugcucccccaggaaugggugcaguauuucuaucaagaggcagccccagcacaaucugacguggcucugcuaagauuugugaauccagacacagguaggguuuuguuugaguguaagcuucauaaaucaggcuauguuacaguggcucauaccggccaacaugauuugguuaucccccccaaugguuauuuuagauuugauuccugggucaaccaguucuacacacuugcccccaugggaaauggaacggggcguagacgugcauuauaa

SEQ ID NO: 4415 - RNA, 1623 nt, Artificial Sequence
  capsid_protein_VP1__Norovirus__ADI45812
augaagauggcgucgagugacgccaacccaucugauggguccacagccaaccucgucccagaggucaacaaugagguuauggcuuuggaacccguuguuggugccgccauugcggcaccuguagcgggccaacaaaauguaauugaccccuggauuagaaacaauuuuguacaagccccugguggagaguucacaguguccccuagaaacgcuccaggugaaauacuauggagcgcgcccuuaggcccugauuugaaucccuaccuuucccauuuggcuagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccacauaauaguggauguuaggcaacuggaaccuguguugauccccuuacccgauguuaggaauaauuucuaucacuacaaucaaucaaaugaccccaccaucaaacugauagcaauguuauauacaccacuuagggcuaauaaugcuggggacgacgucuucacaguuucuugucggguucucacaagaccaucccccgauuuugauuucauauuuuuagugccacccacaguugagucaagaacuaaaccauucucugucccaaucuuaacuguugaggagaugaccaauucaagauuccccauuccuuuggaaaaguuguucacgggucccaguagugccuuuguuguucaaccacaaaacggcaggugcacgacugauggcgugcuccuaggcaccacccaacugucuccugucaacaucugcaccuucagaggggaugucacccauaucacagguagucguaacuacacaaugaauuuggccacucaaaauuggaacaguuaugacccuacagaagaaaucccagccccccuaggaacuccagauuucguggggaagauucaaggcgugcucacccaaacuacaagggcagauggcucgacccgcggccacaaagcuacaguguacacugggagcgccgauuuuacuccaaaacuggguagaguucaauuugccacugacacagacaaugauuuugaugcuaaccaaaacacaaaguucaccccagucggugucauccaggaugguaauacugcccaccgaaaugaaccccaacaaugggugcucccaaguuacucaggcagaaauagucacaaugugcaccuggcccccgcuguagcccccacuuuuccgggugagcaacuucucuucuucagguccacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugaguguaaacuucauaaaucaggcuauguuacaguggcucacaccggccaacaugauuugguuaucccccccaaugguuauuucagauuugauuccugggucaaccaguucuacacacuugcccccaugggaaauggaacggggcguagacgugcacuauaa

SEQ ID NO: 4416 - RNA, 1623 nt, Artificial Sequence
  capsid_protein_VP1__Norovirus__ADI45814
augaagauggcgucgagugacgccaacccaucugauggguccacagccaaccucgucccagaggucaacaaugagguuauggcuuuggagcccguuguuggugccgccauugcggcaccuguggcgggccaacaaaauguaauugaccccuggauuagaaacaauuuuguacaagccccugguggagaguucacaguauccccuaggaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcaguuccaccaaacuucccaacugaaggcuugagccccagccaggucacuauguucccccacauaauaguagauguuaggcaauuggaaccuguguugauccccuuacccgauguuaggaauaauuucuaucacuacaaucaaucaaaugaccccaccaucaaauugauagcaauguuguauacaccacuuagagcuaauaaugcuggagacgaugucuucacaguuucuugucggguucucacgagaccaucccccgauuuugauuucauauuuuuaguaccacccacaguugagucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgacugauggcgugcuccuagguaccacucaacugucuccugucaacaucugcaccuucagaggggaugucacccauauugcagguagucgaaacuacacaaugaauuuggcuacucaaaauuggaacaguuaugacccaacagaagaaaucccagccccucuaggaacuccagauuucguggggaagauucaaggugugcucacccaaaccacaagggcagauggcucgacccgcggccacaaagcuacaguauacacugggagcgccgauuuugcuccaaaacuggguagaguucaauuugccacugacacagacaaugauuuugaugccaaccaaaacacaaaguucaccccagucggugucauccaggauggugauacugcccaccgaaaugaaccccaacaaugggugcucccaaguuacucaggcagaaauagucacaaugugcaccuggcccccgcuguagcccccacuuuuccgggugagcaacuucucuucuucagauccacuaugcccggauguagcggguaccccaacauggauuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugauuugguuaucccccccaaugguuauuuuagauuugauuccugggucaaccaguucuacacacuugcccccaugggaaauggaacggggcguagacgugcauuauaa

SEQ ID NO: 4417 - RNA, 1623 nt, Artificial Sequence
  capsid_protein_VP1__Norovirus__ADI45815
augaagauggcgucgagugacgccaacccauuugauggguccacagccaaccucgucccagaggucaacaaugagguuauggcuuuggaacccguuguuggugccgccauugcggcaccuguggcgggccaacaaaauguaauugaccccuggauuagaaacaauuuuguacaagccccugguggagaguucacaguauccccuagaaacgcuccaggugaaauacuauggagcgcgcccuuaggcccugauuugaaccccuaucuuucccauuuggcuagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccacauaauaguagauguuaggcaacuggaaccuguguugaucccccuacccgauguuaggaauaauuucuaucacuacaaucaaucaaaugaccccaccaucaaacugauagcaauguuauauacaccacuuagggcuaauaaugcuggagacgacgucuucacaguuucuugucggguucucacgaggccaucccccgauuuugauuucauauuuuuagugccacccacaguugagucaagaacuaaaccauucucugucccaaucuuaacuguugaggagaugaccaauucaagauuccccauuccuuuggaaaaguuguuuacgggucccagcagugccuuuguuguucaaccacaaaacggcaggugcacgacugauggcgugcuccuagguaccacccaacugucuccugucaacaucugcaccuucagaggggaugucacccauaucacagguagucguaacuacacaaugaauuuggcuacucaaaauuggaacaguuaugacccaacagaagaaaucccagccccccuaggaacuccagauuucguggggaagauucaaggugugcucacccaaaccacaagggcagauggcucgacucgcggccacaaagcuacaguguacacugggagcgccgacuuugcuccaaaacuggguagaguucaauuugccacugacacagacaaugauuuugaugcuaaccaaaacacaaaguucaccccagucggugucauccaggaugguaauacugcccaccgaaaugaaccccaacaaugggugcucccaaguuacucaggcagaaauagucacaaugugcaccuggcccccgcuguagcccccacuuuuccgggugagcaacuucucuucuucagauccacuaugcccggaugcagcggguaccccaacauggauuuggacugucugcucccucaggaaugggugcaguauuucuaucaagaggcagccccagcacaaucugauguggcucugcuaagauuuguaaauccagacacagguaggguuuuguuugaguguaaacuucauaaaucaggcuauguuacaguggcucacaccggccaacaugauuugguuaucccccccaaugguuauuucagauuugauuccugggucaaccaguucuacacacuugcccccaugggaaauggaacggggcguagacgugcauuauaa

SEQ ID NO: 4418 - RNA, 1623 nt, Artificial Sequence
  capsid_protein_VP1__Norovirus__ADI45816
augaagauggcgucgaaugacgccaacccaucugauggguccgcagccaaccucgucccagagaucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaagugauccccgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaccagucaaaugauucuaccauuaaauugauagcaaugcuguacacaccacuuagggccaauaaugccggggaugaugucuucacagucucuugucgaguccucacgaggccauccccugauuuugacuucauauuuuuggugccaccuacaguugagucaagaacuaagccauuuacugucccaaucuugacuguugaagaaaugaccaauucaagauuccccauuccuuuggaaaaauuguucacgggucccagcagugccuuuguuguucaaccacaaaauggcagaugcacgacugauggcgugcucuuagguaccacccaacugucuccugucaacaucugcaccuucagaggggaugucacccacauugcggguucucguaauuacacaaugaauuuggccucucuaaauuggaacaauuaugacccaacagaagagauuccagccccucugggaacuccagauuucgugggaaagauccaaggugugcucacucaaaccacaaaggaagauggcucgacccggggccacaaagcuacaguuuacacugggagugccgacuucacuccaaagcugggcaguguucaauuugguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccaauuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguagggucuuguuugagugcaaacuucauaaaucaggcuaugucacaguggcucacaccggccaacaugauuuggucaucccccccaaugguuauuuuagguuugauuccuggguuaaucaguucuacacacuugcccccaugggaaauggaacggggcguagacgugcuuuauaa

SEQ ID NO: 4419 - RNA, 1623 nt, Artificial Sequence
  capsid_protein_VP1__Norovirus__ADI45817
augaagauggcgucgaaugacgccaacccaucugauggguccacagccaaccucgucccagaggucaacaaugagguuauggcuuuggagcccguuguaggugccgcuauugcggcgccuguagcgggccaacaaaauguaauugaccccuggauuagaaauaauuuuguacaagccccugguggagaguuuacaguguccccuagaaaugcuccaggugagauauuauggagugcgcccuugggcccugauuugaacccuuaccuuucucaucuggccagaauguauaaugguuaugcaggugguuuugaagugcagguaauccucgcggggaacgcguucaccgccggaaaaaucauauuugcagcaguuccaccuaacuuuccaacugaaggcuugagccccagccagguuacuauguucccccauauaauaguagauguuaggcaauuggaaccuguguugauccccuuaccugauguuaggaauaauuucuaucauuauaaucaaucaaaugacccuaccauuaaauugauagcaaugcuguacacaccacuuagggcuaauaaugcuggggaugaugucuucacagucucuugccgaguccucacgagaccauccccugauuuugauuucauauuuccgguaccaccaacaguugaaucaagaaccaaaccauuuaccguuccgaucuuaacuguugaggaaaugaccaauucaagauuccccauuccuuuggaaagauuguacacgggucccagcagugccuuuguuguccagccacaaaacggcaggugcacgacugauggcgugcucuuaggcaccacccagcugucugcugucaacaucugcaccuuuagaggggaugucacucacauugcaggcucucgcaauuauacaaugaauuuggccucucaaaauuggaacaacuaugauccaacagaagaaaucccagccccccugggcaccccagacuucgugggaaagauccaaggcaugcucacccaaaccacaagaagugauggcucgacucgcggccacaaggccacagugcucacugggagugccgacuucgccccaaaauugggcagaguccaauucgccacugacacagacaacgauuucgaaucuggccaaaacaccaaauucaccccaguuggcgucauccaggaugguuccacuacccaccgaaaugaaccucaacaauggguacucccaaauuacucagguagaacuggucacaaugugcaucuagccccugcuguugcccccacuuacccgggugagcaacuccuuuucuucagguccacuaugcccggauguagcggguaccccaacauggaucuagauugcuugcucccccaggagugggugcagcacuucuaccaagaagcagcuccagcacaaucugauguggcucugcuaagauuugugaauccagacacagguaggguucucuuugagugcaagcuccauaaaucaggauaugucacaguggcucacacuggucagcaugauuugguuauuccccccaaugguuauuuuagauuugauuccuggguuaaucaguucuacacacuugcccccaugggaaauggaacggggcguagacgugcuguauaa

SEQ ID NO: 4420 - RNA, 1623 nt, Artificial Sequence
  capsid_protein_VP1__Norovirus__ADI45818
augaagauggcgucgagugacgcccacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaagcuguucacgggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcuuacacuggccaacaugauuugguuaucccccccaaugguuauuuuagauuugauuccugggucaaccaguucuacacacuugcccccaugggaaaugggacggggcguagacgugcauuauaa

SEQ ID NO: 4421 - RNA, 1626 nt, Artificial Sequence
  capsid_protein_VP1__Norovirus__AET79296
augaggaugagugauggcgcagcgccaaaagccaacggcucugaagccagcggccaggaucuuguuccuaccgccguugaacaggccguccccauucagcccguggcuggugcgucucuugccgcccccgccgccgggcaaaucaaccaaauugacccauggaucuuccaaaauuuuguccaaugccccuugggugaguuuuccauuucaccucgaaacaccccaggugaaauacuguuugaucuggcccucggaccagggcucaacccauaccuugcccaccucucagccauguacaccggcuggguugggaacauggagguucagcugguccucgccggcaaugccuuuacugcuggcaaggugguuguugcccuuguaccacccuauuuucccaaagggucacucaccacugcucagaucacaugcuucccacaugucaugugugaugugcgcacccuggagcccauucaacugccucuucuugacgugcgucgaguucuuuggcaugcuacccaggaucaggaggaaucuaugcgccugguuugcaugcuguacacgccacuccgcacaaacagcccgggugaugagucuuuuguggucucuggccgccuucuaucuaagccggcggcugauuucaauuuuguauaccugaccccucccaucgagagaaccaucuaucggauggucgaccugcccguguugcagccgcggcugugcacgcacgcacguuggccugccccgguguauggucucuugguggacccgucccucccauccaacccccaguggcagaaugguagagugcauguugauggaacccuucuugguacaacaccugugucuggguccugggucuccugcuuugcagcugaggccgccuacgaguuccaaucugggacuggugagguggcaaccuucacccugauugaacaggacggguccgcuuaugucccuggcgacagagcggccccccuuggauaucccgacuucuccgggcaacuggagauugaggugcagacugagacuaccaaggcaggagacaaacugaaggugaccaccuuugaaaugauccucggccccaccaccaauguggaucaggcccccuaccaggguagggugcacgcgagcacaucggucacggccuccuuaaaccugguggauggcaggguuagggcugucccacguuccaucuacagcuuucaggauguggugccagaguauaaugauggucuacuuguuccccuugccccccccauuggucccuuucucccuggugaaguucuucugagguuccgcaccuacaugcgccagauugacagcucugacgccgcggcggaagcuaucgacugugcccucccucaagaauucaucucgugguucgcgagcaacgcauucacggugcagucugaggcucugcuucuuagguacaggaacacccugacggggcaguugcuguuugagugcaagcucuacagcgaggguuacaucgcucuguccuacucagggucaggaccacucaccuucccuacugacggcuucuuugaggucguuaguugggucccccgccuuuaucaauuggccucugugggaagcuuggcaacaggccgaacacucaaacaauaa

SEQ ID NO: 4422 - RNA, 1626 nt, Artificial Sequence
  capsid_protein_VP1__Norovirus__AFB18026
augaggaugagugauggcgcaacgcccaagcccaacggcucugaagccgcaggccaagaucuuguuccuuccuccguugagcaagccauccccauacagcccguggcuggugcggcuguugccgcccccaccgcugggcaaauuaaccaaauugaccccuggauauuccaaaacuuuguccagugcccccuuggcgaguucuccaucucccccagaaacaccccaggugagauuuuguuugauuuggcccucggcccagggcucaauccauaccuugcccaccucucagccauguacaccgguuggguugggaacauggagguucagcugguccucgccggcaaugccuuuacugcuggcaaggugguuguugcccuuguaccaccauauuuuccccaaggcucccucaccaccgcgcagaucacauguuucccacauguuaugugugaugugcgcacccuggaacccauacagcuaccacuucuugauguccgcaggguucucuggcaugcuacucagaaccaagaggaggcuaugcgccuuguuugcaugcucuacacaccucuucggaccaacaguccuggugaugagucauucguuguuucuggccgucugcuuucccgcccuucuccagauuuuaacuuuguuuaccugaccccccccauugagaggacgaucuacaggaugguggaccucccuguugugcagccgaggcugugcacacacucccgguggcccgcucccguuuaccaaauucuaguggaccccucccuccccuccaacccccaguggcagaaugguagggugcugauugaugggacucuucuugggaccaccccaauuuccagcucuuggguggccucuuuugcaggcacggcagaguauaguuuccaguccccucccuccgcugagauuggugaggucucccucuuugagaucgacggcucugccuacacccccggcgaucgggccgccccucuuggguacccugauuucuccggcacauuggaaguggagauacagacugagacaaccaaggcgggccaaaagcucgaugugcacaccuucaaucuugagcucaagagucagacuguggaccaagcccccuuccaggggaaggucuauauggaccucgaggcgucugccucccuggaccucgucaacggccgugugagggccucgcccagaagugucgccgcuuucaaggaugagcugccuagcuacaacagugggcuccugguuccccuugcccccccccuugggcccuuccuccccggagaggugcuuuugagauucagaaccuuugccagacagguugacaccacggaugcguccgcgcaagcggucgacugugcccugccccaggagcucgugucuugguuugccagcagcaauuucacugugcaguccgaggcgcuucuccuaagguacaggaacacacugacugggcagcuccuguuugaguguaagcucuacagcgagggguacaucgcccugucuuauacuggcucuagcccccucaccuuuccuacugauggcuuccuugaggucgucagcugggucccccgacuucaucaauuggccucugugggaagcuuggcaacaggccgcucacugaaacaguaa

SEQ ID NO: 4423 - RNA, 1626 nt, Artificial Sequence
  capsid_protein_VP1__Norovirus__AFB18027
augaggaugagugauggcgcaacgcccaagcccaacggcucugaagccgcaggccaagaucuuguuccuuccuccguugagcaagccauccccauacagcccguggcuggugcggcuguugccgcccccaccgccgggcaaauuaaccaaauugaccccuggauuuuccaaaacuuuguccagugcccccuuggugaguucuccaucuccccuagaaacaccccaggugagauucuguuugauuuggcccucggaccaggucucaacccuuaccucgcccaccucucggccauguacaccggcuggguugggaacauggagguucaacugguccucgccggcaaugccuuuacugcuggcaagguggugguugcccuuguaccaccauacuuccccaagggaucccucaccaccgcgcagaucacauguuucccacauguuaugugugaugugcgcaccuuggaacccauacagcuaccacuucuugauguccgcaggguucucuggcaugcuacucaggaccaagaggaggcuaugcgccuugugugcaugcucuacacgccucuucggaccaacaguccuggugaugagucauucguuguuucuggccgccugcuuucccgcccugcuucagauuuuaacuuuguuuaccugacccccccaauugagaggacaaucuauaggaugguggaccucccuguugugcagccgcggcugugcacgcauucccgauggcccgcucccguuuaucagauccuaguagaccccucccuccccuccaacccucaguggcagaauggcagggugcagguggaugggacccuucucgggaccacgccuguuucugguuccuggguggcauccuuugcuggcaccgcagaguacagcuuccaaacaccccccucugcugaaauuggcaccaucucucuguuugagaucgacggcuccgcguauguccccggggaccgggcugccccacuuggguacccugacuccgcuggcacgcuggagguggagauccagacugagacgaccaaggcuggccagaagcucaacgugcacaccuucagucuugagcugguuagccagacuguggaccaggcccccuaucagggucagaucuucguggaccuugagacauccucguccauggaccuggucaauggccgcgugagagcuucgccuaggaguaucagcggcuuuaaggaugaauugcccaguuacaacaaugggcuccuagucccccuugcccccccucucggccccuuccuucccggugagguacucuugagguucaggaccuucgccgggcagguugaccugacugaugcugccgcgcagccggucgacugcgcucugccccaggaauucgugucuugguucgcuaguaacaacuucacugugcaguccgaggcacuccuccugagguauagaaacacccugacugggcagcuccuguucgagugcaaacucuacagcgaggguuacaucgcccugucuuacacugguucuggcccccucaccuuuccgacugauggcuucuuugagguugucagcugggucccccgacucuaccaauuggccucugugggaagcuuggcaacaggccgcucacugaaacaauaa

SEQ ID NO: 4424 - RNA, 1635 nt, Artificial Sequence
  capsid_protein_VP1__Norovirus__AFI08231
augaugauggcgucuaaggacgccccaacaaacauggauggcaccaguggugccggucagcugguaccagaggcaaauacagcugaaccuauaucaauggacccaguggcuggagccgcaacagcgguugcaacugcuggacaaauuaauaugauugaccccuggauaaugaguaauuuugugcaagccccacaaggggaauucacugucucaccuaauaacaccccuggagauguucuguuugauuuacaauuggggccucaacuaaauccauuccucgcccaucuagcccagauguauaauggcuggguaggcaauaugcgugugaaggugcugcuugcuggcaacgcuuuuacugcagggaaaauaauaauuagcugcauacccccagguuuuaccucccaaaauauuucuauugcccaaaugacaauguuuccucaugucaucgcugacgugaggguucuggaaccuauagaaauaccccuugaggaugugaggaaugugcuguuucacaccaaugacaaccgcccaacaaugaggcuuguaugcauguuguauacccccuugcgagccaauggcaguucuucuggcacggacccuuuugucauagcuggucggguucucaccugcccagauucaaauuucaguuuccuauuuuuaguacccccuaauguagaacaaaagacuagaccuuuuaguguucccaauauaccucugaauacauugucaaauucaaggguaccaucauugaucaagucuaugaccaucucuagagaucagaaucaaauaauucaauuccaaaauggcagggucacauuggauggucaguuacagggcaccacacccacaucagugagccaguuguguaaaauuagaggcacuacauaccacgcaacuggagguaaugggauaaauuuaacagaguugaauggugagccauaccaugccuuugaaagccccgccccgauaggguuuccagaccuuggugguugcgauuggcaucucacagcaacccccacgcaggcuuucaaugauggagcgaaggucgugcgccugucagucacccagggcgcagccuuugcaccacaccuggguaccauacauuacaccacuacugauacugauuacaaccccaacacuagcauaauuugcacacuagauuggcugucccaaacugcuggucagaguaauguugacccuuggcagauaccaacuuaugggucgacuuuaacugaagccgcucaguuggcgccucccaucuuucccccuggguuuggagaaacauugguuuucuuucuaucagacuuuccuauuuccaauggcaagaacggacucaguguaccgugcacucucccacaggaauuugucacccauuuugugaaugaacaggccccaaucagaggagaggccgcccucuuacauuauguugauccugacacucaucguaaucuuggagaguuuaaauuguauccagaagguuuuaugacuuguguuccuaauacuagugguggugguccccaaacuuugccuaucaauggagucuuugucuuuguuucuugggucucucgcuuuuaccaguugaagccugugggaacagccggugcggcucguaggcuuggaaucaggagaucauaa

SEQ ID NO: 4425 - RNA, 1623 nt, Artificial Sequence
  capsid_protein_VP1__Norovirus__AFI08240
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugagauacuauggagcgcgcccuuaggcccugaucugaaucccuaccuaucucacuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaaugcuggggaagacgucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucuguaccuucagaggggaugucacccacauugcagguucucguaauuacacaaugaauuuggcaucucuaaauuggaacaauuaugacccaacagaagaaauuccagccccucuaggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguuuuacacacuugcccccaugggaaacggaacggggcguaggcgcgcuuuauaa

SEQ ID NO: 4426 - RNA, 1620 nt, Artificial Sequence
  capsid_protein_VP1__Norovirus__AFS33552
augaagauggcgucgagugacgccaacccaucugauggguccgcagccaaccucgucccagaggucaacaaugagguuauggcucuggagcccguuguuggugccgcuauugcggcaccuguagcgggccaacaaaauauaauugaccccuggauuagaaauaauuuuguacaagccccugguggagaguuuacaguguccccuagaaacgcuccaggugagauacuauggagcgcgcccuugggcccugauuugaaccccuaucuuucucauuuguccagaauguacaaugguuaugcaggcgguuucgaagugcaaguaauccucgcggggaacgcguucaccgccgggaaaguuauauuugcagcaguuccaccaaacuuuccaacugaaggcuuaagccccagccagguuacuauguucccccauauaauuguagauguuaggcaauuggaaccuguguugaucccccuaccugauguuaggaauaauuucuaucauuacaaucaaucacaugauucuacccuuaaguugauagcaauguuguauacaccacucagggcuaauaaugccggggacgaugucuucacagucucuugucgaguucucacgaggccaucccccgauuuugauuucauauucuuggugccacccacaguugaaucaagaacuaaaccauucaccgucccaaucuuaacuguugaggaaauguccaauucaagauuccccauuccuuuggaaaaguuguacacggguccuagcagugcuuuuguuguccaaccacaaaauggcagaugcacgacugauggcgugcucuuagguacuacccagcugucagcugucaacaucuguaacuuuaggggggaugucacccauauugugggcagccaugauuauacaaugaaucuggcuucccaaaauuggagcaauuaugacccaacagaagaaaucccagccccccugggaacaccagauuuuguggggaagauccaaggccugcucacccagaccacaagagcggauggcucgacccgugcccacaaagcuacagugagcacugggaguguccacuucacuccaaagcuggguaguguucaauucaccacugacacaaacaaugauuuccaaacuggccaaaacacgaaauucaccccaguuggcgucauccaggacggugaucaccaucagaaugagccccaacaauggguacucccaaauuacucagguagaacuggucauaaugugcaccuggccccugccguugcccccacuuuuccgggugagcaacuccuuuucuuuagauccacuaugcccggauguagcggguaucccaacaugaauuuggauugccuacucccccaggaaugggugcugcacuucuaccaggaagcagcuccagcacaauccgauguggcucugcugagauuugugaauccagacacagguaggguucuguuugagugcaagcuccauaaaucaggcuauaucacaguggcucacacuggcccguaugacuugguuaucccccccaaugguuauuuuagauuugauuccugggucaaccaguucuacacacuugcccccaugggaaauggaacggggcgcaggcgugcauuauaa

SEQ ID NO: 4427 - RNA, 1608 nt, Artificial Sequence
  capsid_protein_VP1__Norovirus__AFS33555
augaagauggcgucgaaugacgccgccccaucuaaugauggugcagccggucucguaccagaggucaacaacgagacgauggcccucgaaccgguggcuggggcuucuauagccgccccucuaaccggucaaaauaaugugauagaccccuggauuagaaugaacuuuguccaagccccaaauggagaauucacagugucuccccgcaauucuccuggugaaaucuugcuaaauuuggaauuaggcccugaauuaaauccauucuuagcacaccuuucaagaauguauaaugguuaugccggcgggguugaagugcagguacuacucgcugggaacgcguucacagcgggaaaacugguguuugcagcaauccccccgcacuucccucuugagaaucugaguccuggacaaauuacaauguucccucaugugauuauugauguuagaacauuagaaccugugcuuuugccccuuccagauguuagaaauaauuucuuucauuacaaucagcagcccgagccccguaugagacuuguagcuauguuguauacuccucuuagaucuaaugguucuggugaugauguguucacaguuucuugcaggguucucacccgcccuucuccagauuuugauuuuaauuauuugguucccccaacuguggagucuaaaacuaaaccauucacccugccaauccuaacuauuggagaauugucaaauucuagauucccaguuccaauagaugaauuguacaccagccccaaugaaggagugaucgugcagccccaaaauggcagaucaacacuugauggugaauuguugggcaccacgcaacucgugcccucaaacaucugugcgcuacgagggcgcauuaacgcccaggugccagaugaucaccaucaauggaaccuacagguaacaaacacaaaugggacuccuuucgaccccaccgaagacgucccugcaccacugggcacaccggauuuccuggcgaauaucuauggagucaccagccagagaaaccccaacaacacuugccgugcccaugaugggguuuuggcaacuuggagccccaaauuuacacccaaguuaggaucugugauuuugggcacuugggaagaaagugaucuugaucucaaucagcccacaagguucacaccuguuggucuguuuaacacugaccacuuugaucagugggccuugccuaguuauucuggaagauuaacccuaaacaugaauuuggcacccucuguuuccccccucuuuccaggugaacagcuacuuuucuucaggucccauauaccacucaaaggagguaccucugauggugccauugauugucuacucccccaggaauggauucagcauuuuuaucaggagucagccccaucgcccacggacguggcucuaauuagauacaccaauccugacacaggccgcguuuuguuugaagcuaaacugcacaggcaaggauucaucacaguggcaaacucugguucuaggccuauuguugucccuccgaauggcuauuuuagguuugauucuuggguuaaucaauucuauucucucgcccccaugggaacugggaacgggcgcagaagagugcaguaa

SEQ ID NO: 4428 - RNA, 1623 nt, Artificial Sequence
  capsid_protein_VP1__Norovirus__AFW15938
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuacuauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaacuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucagcacugauacagaaaaugauuuugaaacucaccaaaacacaaaauucaccccagucggugucauccaggaugguagcaccacccaccgaaaugaaccccaacaaugggugcucccaaguuauucagguagaaaugcccagaauguacaccuagccccugcuguagcccccacuuuuccgggugaacaacuucuuuucuuuagguccacuaugcccggaugcagcggguaucccaacauggaucuggauugccuacucccccaggagugggugcagcauuucuaccaagaggcagcuccagcacaaucugauguggcucuauugagauucgugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 4429 - RNA, 1623 nt, Artificial Sequence
  capsid_protein_VP1__Norovirus__AFW15940
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuacuauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaaaaacuaaaccauuuacugucccaaucuuaacuguugaagaaaugaccaauucaagauuccccauuccuuuggaaaaguuguucacgggucccagcagugccuuuguuguucaaccacaaaauggcagaugcacgacugauggcgugcucuuaggcaccacccaacugucuccugucaacaucugcaccuucagaggggaugucacccacauugcagguucucgcaacuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucagcacugauacagaaaaugauuuugaaacucaccaaaacacaaaauucaccccagucggugucauccaggaugguagcaccacccaccgaaaugaaccccaacaaugggugcucccaaguuauucagguagaaaugcccagaauguacaccuagccccugcuguagcccccacuuuuccgggugaacaacuucuuuucuuuagguccacuaugcccggaugcagcggguaucccaacauggaucuggauugccuacucccccaggagugggugcagcauuucuaccaagaggcagcuccagcacaaucugauguggcucuauugagauucgugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 4430 - RNA, 1623 nt, Artificial Sequence
  capsid_protein_VP1__Norovirus__AFW15941
augaagauggcgucgaaugacgccaacccaucugauggguccgcagccaaccucgucccagaggucaacaaugagguuauggcuuuggagcccguugucggugccgcuauugcggcgccuguagcgggccaacaaaaugugauugaccccuggauuagaaauaauuuuguacaagccccugguggagaguucacaguauccccuagaaacgcuccaggugaaauacuauggagcgcgcccuuaggcccugaucugaaucccuaccuaucccauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaccacuauaaucagucaaaugauucuaccauuaaauugauagcaaugcuguauacaccacuuagggcuaauaaugcuggggaggaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguuuacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagacgguucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccggaaugaaccccaacaaugggugcucccaaguuauucagguagaaauguccaaaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaagcuucacaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 4431 - RNA, 1623 nt, Artificial Sequence
  capsid_protein_VP1__Norovirus__AFW15944
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucaaucaaaugacuccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaacucaagguuccccauuccuuuggaaaaauuguucacgggccccaguagugccuuuguuguucaaccacaaaacggcaggugcacgacugauggcgugcuccuagguaccacccaacugucuccugucaacaucugcaccuucagaggggaugucacccacauuccaggcagucguaacuacacaaugaauuuggccucccaaaauuggagcaguuacgauccaacagaagaaaucccagccccucuaggaaccccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauccauaaugugcaccuagcccccgcuguagcccccacuuucccgggcgagcagcuucucuucuucagauccacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 4432 - RNA, 1623 nt, Artificial Sequence
  capsid_protein_VP1__Norovirus__AFW15947
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguauaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaguuggaaccuguguugauccccuuacccgauguuaggaauaauuucuaccauuauaaucaaucaaaugacuccaccaucaaauugauagcaauguuguauacaccacuuagggcuaauaaugccggggacgaugucuucacaguuucuugucgaguucucacgagaccaucccccgauuuugauuuuauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccccaaaacggcagguguacgacugauggcgugcuccuagguacuacccaauugucuccugucaacaucugcacauucagaggggaugucacccacauuccaggcagucguaacuacacaaugaauuuggccucccaaaacuggaacaguuacgauccaacagaagaaaucccagccccucuaggaacuccagauuuuguggggaaaauccaaggugugcucacccaaaccacaaggacaaauggcucgacccgcggccacaaagcuacaguguacacugggagcgccgacuuuucuccaaaacuggguaggguucaauuugccacugacacagacaaugauuuugaaacuaaccaaaacacaaaguucaccccagucggcguuauccaggaugguagcacuaccccccgaaaugaaccccaacaaugggugcucccaaguuacucaggcagaaacauucacaaugugcaccuggcccccgcuguagcccccacuuucccgggcgagcagcuccucuucuucagaucuacuaugcccggaugcagcggguaccccaacauggacuuggacugucugcucccccaggaaugggugcaguacuucuaccaggaggcagccccagcacaauccgauguggcucuguuaagauuugugaauccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacgugcauuauaa

SEQ ID NO: 4433 - RNA, 1623 nt, Artificial Sequence
  capsid_protein_VP1__Norovirus__AFW15948
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguauaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaguuggagccuguguugauccccuuacccgauguuaggaauaauuucuaccauuauaaucaaucaaaugacuccaccaucaaauugauagcaauguuguauacaccacuuagggcuaauaaugccggggacgaugucuucacaguuucuugucgaguucucacgagaccaucccccgauuuugauuuuauauuuuuggugccacccacaguugaaucaagaacuaaaccauucucugucccaguuuuaacuguugaggagaugaccaauucaagguuccccauuccuuuggaaaaguuguucacgggccccaguaaugccuuuguuguucaaccccaaaacggcagguguacgacugauggcgugcuccuagguacuacccaauugucuccugucaacaucugcacauucagaggggaugucacccacauuccaggcagucguaacuacacaaugaauuuggccucccaaaacuggaacaguuacgauccaacagaagaaaucccagccccucuaggaacuccagauuuuguggggaaaauccaaggugugcucacccaaaccacaaggacaaauggcucgacccgcggccacaaagcuacaguguacacugggagcgccgacuuuucuccaaaacuggguaggguucaauuugccacugacacagacaaugauuuugaaacuaaccaaaacacaaaguucaccccagucggcguuauccaggaugguagcacuaccccccgaaaugaaccccaacaaugggugcucccaaguuacucaggcagaaacauucacaaugugcaccuggcccccgcuguagcccccacuuucccgggcgagcagcuccucuucuucagaucuacuaugcccggaugcagcggguaccccaacauggacuuggacugucugcucccccaggaaugggugcaguacuucuaccaggaggcagccccagcacaauccgauguggcucuguuaagauuugugaauccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacgugcauuauaa

SEQ ID NO: 4434 - RNA, 1623 nt, Artificial Sequence; identical to SEQ ID NO: 4432
  capsid_protein_VP1__Norovirus__AFW15949

SEQ ID NO: 4435 - RNA, 1623 nt, Artificial Sequence
  capsid_protein_VP1__Norovirus__AFW15950
augaagauggcgucgagugacgccaacccaucugauggguccacagccaaccucgucccagaggucaacaaugagguuauggcuuuggagcccguaguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucugaaucccuaccuuucccauuuggccagaauguacaaugguuaugcaggugguuuugaagugcagguaauucucgcggggaacgcguucaccgccgggaaaauuauauuugcagcagucccgccaaauuucccaacugaagguuugagccccagccaggucacuauguucccccacauaauaguagauguuaggcaauuggaaccuguguugauccccuuacccgauguuaggaauaacuucuaucacuauaaucaaucaaaugauucuaccaucaaauugauagcaauguuguauacaccacuuagggcuaauaaugccggggaugacgucuucacaguuucuugucgaguucucacgagaccaucccccgauuuugauuuuauauuuuuggugccacccacaguugaaucaagaacuaaaccauucucugucccaaucuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacgucugcaccuucagaggggaugucacccauauuucaggcagucguaacuacacaaugaauuuggccucccaaaauuggaccaguuacgauccaacagaagaaaucccagccccucuaggaacuccagauuucguggggaaaauucaaggugugcucacccaaaccacaaggacaaauggcucgacccgcggccacaaagcuacaguguacacugggagcgccgacuuuucuccaaaacuggguagaguucaauuugccacugauacagacaaugauuuugaaacuaaccaaaacacaaaguucaccccagucggcguuauccaggaugguaguacuaccccccgaaaugaaccccaacaaugggugcucccaaguuacucaggcaggaacauucacaaugugcaccuggcccccgcuguagcccccacuuucccgggcgagcagcuccucuuuuucaggucuacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacgugcauuauaa

SEQ ID NO: 4436 - RNA, 1623 nt, Artificial Sequence
  capsid_protein_VP1__Norovirus__AFW15951
augaagauggcgucgagugacgccaacccaucugauggguccacagccaaccucgucccagaggucaacaaugagguuauggcuuuggagcccguaguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucugaaucccuaccuuucccauuuggccagaauguacaaugguuaugcaggugguuuugaagugcagguaauucucgcggggaacgcguucaccgccgggaaaauuauauuugcagcagucccgccaaauuucccaacugaagguuugagccccagccaggucacuauguucccccacauaauaguagauguuaggcaauuggaaccuguguugauccccuuacccgauguuaggaauaacuucuaucacuauaaucaaucaaaugauucuaccaucaaauugauagcaauguuguauacaccacuuagggcuaauaaugccggggaugacgucuucacaguuucuugucgaguucucacgagaccaucccccgauuuugauuuuauauuuuuggugccacccacaguugaaucaagaacuaaaccauucucugucccaaucuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuucaggcagucguaacuacacaaugaauuuggccucccaaaauuggaccaguuacgauccaacagaagaaaucccagccccucuaggaacuccagauuucguggggaaaauucaaggugugcucacccaaaccacaaggacaaauggcucgacccgcggccacaaagcuacaguguacacugggagcgccgacuuuucuccaaaacuggguagaguucaauuugccacugauacagacaaugauuuugaaacuaaccaaaacacaaaguucaccccagucggcguuauccaggaugguaguacuaccccccgaaaugaaccccaacaaugggugcucccaaguuacucaggcaggaacauucacaaugugcaccuggcccccgcuguagcccccacuuucccgggcgagcagcuccucuuuuucaggucuacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacgugcauuauaa

SEQ ID NO: 4437 - RNA, 1653 nt, Artificial Sequence
  capsid_protein_VP1__Norovirus__AFX71665
augaagauggcgucgaaugacgcugcuccaucgaaugauggugcugccaaccucguaccagaggccaacaaugagguuauggcacuugaaccgguggugggagccucaaucgcagcuccuguugucggucagcaaaauauaauugaccccuggauuagagaaaauuuuguccaagcaccacagggcgaguucacuguuucaccaaggaauucgccuggugagaugcucuuaaaucuugagcugggcccagaacuuaaucccuauuugagucauuugucccgcauguacaacggauaugcugguggcaugcagguucaggugguccuagcugggaaugcguucacagcugggaaaaucaucuuugccgccguaccaccacauuucccuguagaaaacaucagugcagcccagauaacuauguguccccaugugauuguugaugugagacagcuugaaccagugcuuuugccccucccugauauaagaaauagguucuuccauuacaaccaggagaacaccccccggaugaggcucguagccaugcucuauacaccucuaagggccaauucuggcgaggauguguucacuguguccuguaggguucugacucgccccgcuccagauuuugaguucacauuuuuagugccaccaacugucgaaucaaaaacaaaacccuuuacuuuaccuauccuaacccuuggugaguugucuaacucccgcuuuccggcugcuauagauaugcuuuacacugaccccaaugagucaauaguuguacagccccaaaaugguaggugcacucuugauggcaccuugcaaggcacaacacaauuaguucccacacagauuugugcuuuuagagguacccugaucagccaaaccgcgagagcggcugacucaacagacuccccccagagagcccguaaucauccauuacacguccaggucaagaaccuagacggcacacaguacgacccaacggaugauauaccugcaguccuuggggcuauugacuuccaaggcacagucuuuggaguggcuagucagagggaugucucuggacaacaagaacagggccacuaugccaccagagcccaugaagcacacauugacacaacugacccaaaguaugcacccaaauugggcacaauucuuauuaaaucugauucugaugauuuuaauacaaaucagcccauuagguucacuccggugggcaugggugacaacaauuggagacagugggaauuacccgauuauucuggcagacuaaccuugaauaugaaccuagccccugccguuucuccauccuucccuggugaacgaauccuuuucuucaggucuauaguaccaucagccggcggcuacgggucugguuauauagacugucucauaccccaggaauggguacaacacuucuaccaggaagcagcgccuucacaaucugccguugcacugguuagguaugucaaucccgauacugggcguaacaucuuugaggccaaguuacacagagaaggcuuccucaccguggccaauucuggaaacaacccaauuguggucccccccaaugguuauuuuagguuugaggcuuggguuaaucaguuuuacacacuugcccccaugggaucuggacaggggcguagaagggcccaguaa

SEQ ID NO: 4438 - RNA, 1623 nt, Artificial Sequence
  capsid_protein_VP1__Norovirus__AFX71668
augaagauggcgucgagugacgccagcccaucugauggguccacagccaaccucgucccagaggucaacaaugagguuauggcuuuggagcccguagcuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaauuggaaccuguguugauccccuuacccgauguuaggaauaacuucuaccauuacaaucaauuaaaugaccccaccaucaaauugauagcaauguuguacacaccacuuagggcuaauaaugcuggggacgaugucuucacaguuucuugucgaguucuuacgagaccaucccccgauuuugauuucauauuuuuggugccacccacaguugaaucaagaacuaaaccauucucugucccaguuuuaacuguugaggaaaugaccaauucaagguuccccauuccuuuggaaaaguuguucacgggccccaguagugccuucguuguucaaccacaaaauggcaggugcacgacugauggcgugcuccuagguacuacccaacuguccccugucaacaucugcaccuucagaggggaugucacccauauuucaggcagucguaacuacacaaugaauuuggccucccaaaauuggaauaguuacgauccaacagaagaaaucccagccccucuaggaacuccagauuucguggggaagauucaaggugugcucacccaaaccacaaggacaaauggcucgacccgcggccacaaagcuacaguuuacacugggagcgccgacuuuucuccaaaacuggguagaguucaauuugccacugacacagacaaugauuuugaaacuaaccaaaacacaaaguucaccccagucgguguuauccaagaugguaacaccaccccccgaaaugaaccccaacaaugggugcucccaaguuacucaggcagaaacauucaaaaugugcaccuggcccccgcuguagcccccacuuucccgggcgagcagcuccucuucuucagaucuacuaugcccggaugcagcggguaccccaacauggacuuggacugucugcucccccaggaaugggugcaguacuucuaccaggaagcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 4439 - RNA, 1623 nt, Artificial Sequence
  capsid_protein_VP1__Norovirus__AFX81121
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaaugcuggggaagacgucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucuaggaacuccagauuucgugggaaagauccaaggugugcucacucaaaccacaaaaggagauggcucgacccguggccauaaagcuacaguuuacacugggagugcucccuuuacuccaaagcugggcaguguucaauucaguacugacacagaaaaugauuuugaaacucaccaaaacacaaaauuuaccccagucggugucauacaggacgguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacgggcaggguccuguuugagugcaaacuucauaaaucaggcuaugucacaguggcucacaccggucagcaugauuuggucaucccccccaauggcuauuuuagguuugauuccuggguuaaucaguuuuacacacuugcccccaugggaaacggaacggggcguaggcgcgcuuuauaa

SEQ ID NO: 4440 - RNA, 1623 nt, Artificial Sequence
  capsid_protein_VP1__Norovirus__AFX81127
augaagauggcgucgaaugacgccaacccaucugauggguccgcagccaaccucgucccagaggucagcaaugagguuauggcuuuggaacccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccuugcggggaacgcguucaccgccggaaaaauuauauuugcagcagucccaccaaacuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuucccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggauguagcggguaucccaacauggauuuggauugccuacucccccaggagugggugcagcacuucuaccaagaggcagccccagcacagucugauguggcucuauugagauuugugaauccagacacggguaggguccuguuugagugcaaacuucauaaaucaggcuaugucacaguggcccacaccggucagcaugauuuggucaucccccccaauggcuauuuuagguuugauuccuggguuaaucaguucuacacacuugcccccaugggaaacggaacggggcguaggcgcgcuuuauaa

SEQ ID NO: 4441 - RNA, 1623 nt, Artificial Sequence
  capsid_protein_VP1__Norovirus__AFX81130
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccuugcggggaacgcguucaccgccggaaaaauuauauuugcagcagucccaccaaacuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuucccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggauguagcggguaucccaacauggauuuggauugccuacucccccaggagugggugcagcacuucuaccaagaggcagcuccagcacagucugauguggcucuauugagauuugugaauccagacacggguaggguccuguuugagugcaaacuucauaaaucaggcuaugucacaguggcccacaccggucagcaugauuuggucaucccccccaauggcuauuuuagguuugauuccuggguuaaucaguucuacacacuugcccccaugggaaacggaacggggcguaggcgcgcuuuauaa

SEQ ID NO: 4442 - RNA, 1623 nt, Artificial Sequence
  capsid_protein_VP1__Norovirus__AFX81136
augaagauggcgucgaaugacgccaacccaucugauggguccgcagccaaccucgucccagaggucagcaaugagguuauggcuuuggaacccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccuugcggggaacgcguucaccgccggaaaaauuauauuugcagcagucccaccaaacuucccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuucccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggauguagcggguaucccaacauggauuuggauugccuacucccccaggagugggugcagcacuucuaccaagaggcagcuccagcacagucugauguggcucuauugagauuugugaauccagacacggguaggguccuguuugagugcaaacuucauaaaucaggcuaugucacaguggcccacaccggucagcaugauuuggucaucccccccaauggcuauuuuagguuugauuccuggguuaaucaguucuacacacuugcccccaugggaaacggaacggggcguaggcgcgcuuuauaa

SEQ ID NO: 4443 - RNA, 1623 nt, Artificial Sequence
  capsid_protein_VP1__Norovirus__AFX81139
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagacuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaucaaaacacaaaauucaccccagucggugucauccaggaugguggcaccacccaccgaaaugaaccccaacaaugggugcucccaaguuauucagguagagauguucauaauguacaccuagccccugcuguggcccccacuuuuccgggugaacaacuccuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucagguuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4444 - RNA, 1623 nt, Artificial Sequence
  capsid_protein_VP1__Norovirus__AFX81142
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuaggaacgcuccaggugaaauacuauggagcgcgcccuuaggcccugaucugaaccccuaccuaucccauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaaucuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4445 - RNA, 1623 nt, Artificial Sequence
  capsid_protein_VP1__Norovirus__AFX81145
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucccauuuggccagaauguauaaugguuaugcaggugguuuugaagugcaggugauucucgcggggaacgcguucaccgccggaaaaauuauauuugcagcagucccaccaaauuuuccaacugaaggccugagucccagccaagucacuauguucccccacauaauaguagauguuaggcaauuggaaccuguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggccccagcggugccuuuguuguccaaccgcaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagcccccgcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcccaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4446 - RNA, 1623 nt, Artificial Sequence
  capsid_protein_VP1__Norovirus__AFX81148
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccuugcggggaacgcguucaccgccggaaaaauuauauuugcagcagucccaccaaacuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuucccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcaggaucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggauguagcggguaucccaacauggauuuggauugccuacucccccaggagugggugcagcacuucuaccaagaggcagcuccagcacagucugauguggcucuauugagauuugugaauccagacacggguaggguccuguuugagugcaaacuucauaaaucaggcuaugucacaguggcccacaccggucagcaugauuuggucaucccccccaauggcuauuuuagguuugauuccuggguuaaucaguucuacacacuugcccccaugggaaacggaacggggcguaggcgcgcuuuauaa

SEQ ID NO: 4447 - RNA, 1623 nt, Artificial Sequence
  capsid_protein_VP1__Norovirus__AFX81154
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccuugcggggaacgcguucaccgccggaaaaauuauauuugcagcagucccaccaaacuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccgcccacaguugagucaagaacuaaaccauuuacugucccaaucuuaaccguugaagaaaugaccaauucaagauuucccauuccuuuggaaaaguuguucacgggucccagcggugccuuuguuguccaaccacaaaauggcaggugcacgacugauggcgugcucuuagguaccacccaacugucuccugucaacaucugcaccuucagaggggaugucacccacauugcaggaucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaaacugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggauguagcggguaucccaacauggauuuggauugccuacucccccaggagugggugcagcacuucuaccaagaggcagcuccagcacagucugauguggcucuauugagauuugugaauccagacacggguaggguccuguuugagugcaaacuccauaaaucaggcuaugucacaguggcccacaccggucagcaugauuuggucaucccccccaauggcuauuuuagguuugauuccuggguuaaucaguucuacacacuugcccccaugggaaacggaacggggcguaggcgcgcuuuauaa

SEQ ID NO: 4448 - RNA, 1623 nt, Artificial Sequence
  capsid_protein_VP1__Norovirus__AFX81157
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccuugcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuucccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcaggaucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggauguagcggguaucccaacauggauuuggauugccuacucccccaggagugggugcagcacuucuaccaagaggcagcuccagcacagucugauguggcucuauugagauuugugaauccagacacggguaggguccuguuugagugcaaacuucauaaaucaggcuaugucacaguggcccacaccggucagcaugauuuggucaucccccccaauggcuauuuuagguuugauuccuggguuaaucaguucuacacacuugcccccaugggaaacggaacggggcguaggcgcgcuuuauaa

SEQ ID NO: 4449 - RNA, 1623 nt, Artificial Sequence
  capsid_protein_VP1__Norovirus__AFX81163
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaacgcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugcuuuuguuguccaaccacaaaauggcaggugcacgacugauggcgugcucuuaggcaccacccaacugucucccgucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4450 - RNA, 1623 nt, Artificial Sequence
  capsid_protein_VP1__Norovirus__AFX81166
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaucuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaccagucaaaugauucuaccauuaaacugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugacuaauucaagguuccccauuccuuuggaaaaacuguucacgggucccagcagcgccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaacuggaacaauuaugacccaacagaagaaauuccagccccucuaggaacuccagauuucgugggaaagauccaaggugugcucacucaaaccacaaagggagaugguucgacccguggccauaaagccacaguuuacacugggagugcccccuucacuccaaagcugggcaguguucaauucagcaccgacacagaaaaugauuuugaaacucaccaaaacacaaaauucaccccagucggcgucauccaggaugguggcaccacccaccgaaaugaaccucaacaaugggugcucccaaguuauucagguagaaaugucccuaauguacaccuagccccugcuguagcccccacuuuuccgggugaacaacuucucuucuuuagguccacuaugcccggaugcagcggguaucccaacauggauuuggauugccuacucccccaggagugggugcagcacuucuaccaagaggcagcuccagcacaaucugauguggcucuauuaagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 4451 - RNA, 1623 nt, Artificial Sequence
  capsid_protein_VP1__Norovirus__AFX81169
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaccauuauaaucagacaaaugauucuaccauuaaauugauagcaaugcuguauacaccacuuagggccaauaacgcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugcuuuuguuguccaaccacaaaauggcaggugcacgacugauggcgugcucuuaggcaccacccaacugucucccgucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaaguugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4452 - RNA, 1623 nt, Artificial Sequence
  capsid_protein_VP1__Norovirus__AFX81172
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucaccauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaacgcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugcuuuuguuguccaaccacaaaauggcaggugcacgacugauggcgugcucuuaggcaccacccaacugucucccgucaacaucugcaccuucagaggggaugucacccacauugcagguucucguaauuacacaaugaauuuggcaucucuaaauuggaacaauuaugacccaacagaagaaauuccagccccucugggaacuccagauuuugugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4453 - RNA, 1623 nt, Artificial Sequence
  capsid_protein_VP1__Norovirus__AFX81178
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuucguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucaccauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaacgcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugcuuuuguuguccaaccacaaaauggcaggugcacgacugauggcgugcucuuaggcaccacccaacugucucccgucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4454 - RNA, 1623 nt, Artificial Sequence
  capsid_protein_VP1__Norovirus__AFX81181
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauuaauagcaaugcuguauacaccacuuagggccaauaacgcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugcuuuuguuguccaaccacaaaauggcaggugcacgacugauggcgugcucuuaggcaccacccaacugucucccgucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4455 - RNA, 1623 nt, Artificial Sequence
  capsid_protein_VP1__Norovirus__AFX81190
augaagauggcgucgaaugacgccaacccaucugauggguccgcagccaaccucgucccagaggucagcaaugagguuauggcuuuggaacccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccuugcggggaacgcguucaccgccggaaaaauuauauuugcagcagucccaccaaacuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuucccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucuuggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucugguagagauguucauaauguacaccuagccccugcuguagcccccacuuuuccgggugaacaacuucuuuucuucagguccacuaugcccggauguagcggguaucccaacauggauuuggauugccuacucccccaggagugggugcagcacuucuaccaagaggcagcuccagcacagucugauguggcucuauugagauuuguaaauccagacacggguaggguccuguuugagugcaaacuucauaaaucaggcuaugucacaguggcccacaccggucagcaugauuuggucaucccccccaauggcuauuuuagguuugauuccuggguuaaucaguucuacacacuugcccccaugggaaacggaacggggcguaggcgcgcuuuauaa

SEQ ID NO: 4456 - RNA, 1623 nt, Artificial Sequence; identical to SEQ ID NO: 4451
  capsid_protein_VP1__Norovirus__AFX81193

SEQ ID NO: 4457 - RNA, 1623 nt, Artificial Sequence; identical to SEQ ID NO: 4453
  capsid_protein_VP1__Norovirus__AFX81196

SEQ ID NO: 4458 - RNA, 1623 nt, Artificial Sequence
  capsid_protein_VP1__Norovirus__AFX81199
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucccauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucgugauuacacaaugaauuuggcaucucuaaauuggaacaauuaugacccaacagaagaaauuccagccccucugggaacuccagauuucgugggaaagauccaaggugugcucacucagaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguggcccccacuuuuccgggugaacaacuucuuuucuucagguccacuaugcccggaugcagcggguaucccaacauggauuuggauugccuacucccccaggaaugggugcagcacuucuaccaagaggcagcuccagcacaaucugauguggcucuauugagauuugugaauccagacacggguaggguccuguuugagugcaaacuucacaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4459 - RNA, 1623 nt, Artificial Sequence
  capsid_protein_VP1__Norovirus__AFX81202
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauuaauagcaaugcuguauacaccacuuagggccaauaacgcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugcuuuuguuguccaaccacaaaauggcaggugcacgacugauggcgugcucuuaggcaccacccaacugucucccgucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggaucuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4460 - RNA, 1623 nt, Artificial Sequence
  capsid_protein_VP1__Norovirus__AFX81205
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaucuaucccauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggcgcucccaaguuauucagguagagauguucauaauguacaccuagccccugcuguggcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4461 - RNA, 1623 nt, Artificial Sequence
  capsid_protein_VP1__Norovirus__AFX81208
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaccccuaccuaucccauuuggccagaauguauaaugguuaugcaggugguuuugaagugcaggugauccucgcggggaacgcguucaccgccgggaaaauuauauuugcagcagucccaccaaauuuuccaacugaaggccugagucccagccaggucacuauguucccccacauaauaguagauguuaggcaauuagaaccuguguugauccccuuaccugauguuaggaauaacuucuaucacuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuaccccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguggcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccugggucaaucaguucuacacgcuugcccccaugggaaacggaacggggcguaggcgcgccuuauaa

SEQ ID NO: 4462 - RNA, 1623 nt, Artificial Sequence
  capsid_protein_VP1__Norovirus__AFX81211
augaagauggcgucgaaugacgccaacccaucugauggguccgcagccaaccucgucccagaggucagcaaugagguuauggcuuuggaacccguugucggugccgcuauugcggcgccuguagcgggccaacaaaauguaauugaccccuggauuagaaacaauuuuguacaagccccugguggagaguucacaguaucccccagaaacgcuccaggcgaaauacuauggagcgcgcccuuaggcccugaucugaaucccuaccuaucucauuuggccagaauguauaaugguuaugcaggugguuuugaagugcaggugauccuugcggggaacgcguucaccgccggaaaaauuauauuugcagcagucccaccaaacuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuucccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagcuccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucugguagagauguucauaauguacaccuagccccugcuguagcccccacuuuuccgggugaacaacuucuuuucuucagguccacuaugcccggauguagcggguaucccaacauggauuuggauugccuacucccccaggagugggugcagcacuucuaccaagaggcagcuccagcacagucugauguggcucuauugagauuuguaaauccagacacggguaggguccuguuugagugcaaacuucauaaaucaggcuaugucacaguggcccacaccggucagcaugauuuggucaucccccccaauggcuauuuuagguuugauuccuggguuaaucaguucuacacacuugcccccaugggaaacggaacggggcguaggcgcgcuuuauaa

SEQ ID NO: 4463 - RNA, 1623 nt, Artificial Sequence
  capsid_protein_VP1__Norovirus__AFX81214
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaacgcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaagcuguucacgggucccagcggugcuuuuguuguccaaccacaaaauggcaggugcacgacugauggcgugcucuuaggcaccacccaacugucucccgucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccaguaggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4464 - RNA, 1623 nt, Artificial Sequence
  capsid_protein_VP1__Norovirus__AFX81226
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacgguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaguuggaaccuguguugauccccuuaccugauguuaggaauaauuucuaucauuauaaucagacaaaugauucuaccauuaaacugauagcaaugcuguauacaccacuuagggccaauaacgcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugcuuuuguuguccaaccacaaaauggcaggugcacgacugauggcgugcucuuaggcaccacccaacugucucccgucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccacaaagcuacaguuuacacugggagugcccccuucacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4465 - RNA, 1623 nt, Artificial Sequence
  capsid_protein_VP1__Norovirus__AFX81229
augaagauggcgucgaaugacgccaacccaucugauggguccgcagccaaccucgucccagaggucagcaaugagguuauggcuuuggagcccguugucggugccgccauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuacuuaucccauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacuguuccaaucuuaaccguugaagaaaugaccaauucaagauuccccauuccuuuggaaaaguuguucacgggccccagcggugccuuuguuguccaaccacaaaauggcaggugcacgacugauggcgugcucuuaggcaccacccaacuaucuccugucaacaucugcaccuucagaggggaugucacccacauugcagguucucguaauuacacaaugaguuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacacuuagccccugcuguggcccccacuuucccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcucgcccccaugggaaacggaacggggcguaggcgcgccuuauaa

SEQ ID NO: 4466 - RNA, 1623 nt, Artificial Sequence
  capsid_protein_VP1__Norovirus__AFX81232
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguuuacaguauccccuagaaacgcuccaggugaaauacuauggagugcgcccuuaggcccugaucugaaucccuaccuaucccauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucaccauguucccccacauaauaguagauguuaggcaauuggaaccuguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucagaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguggcccccacuuuucccggugaacaacuucuuuucuucagguccacuaugcccggaugcagcggguaucccaacauggauuuggauugccuacucccccaggagugggugcaacacuucuaccaagaggcagcuccagcacaaucugauguggcucuauugagauuugugaauccagacacggguaggguccuguuugagugcaaacuucacaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4467 - RNA, 1623 nt, Artificial Sequence
  capsid_protein_VP1__Norovirus__AFX81238
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucagacaaaugauucuaccauuaaauugauagcaaugcuguauacaccacucagggccaauaaugcuggggaagaugucuuuacagucucuugucgaguccucacuaggccguccccugauuuugauuuuauauuuuuggugccacccacaguugagucaagaaccaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggauguagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4468 - RNA, 1623 nt, Artificial Sequence
  capsid_protein_VP1__Norovirus__AFX81241
augaagauggcgucgagugacgccaacccaucugauggguccacagccaaccuugucccagaggucaauaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggacgucacccauauuucaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaauggguacucccaaguuacucaggcagaaacauucauaaugugcaccuggcccccgcuguagcccccacuuucccgggcgagcagcuccucuucuucagaucuacuaugcccggaugcagcggguaccccaacauggacuuggacugucugcucccccaggaaugggugcaauauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 4469 - RNA, 1623 nt, Artificial Sequence
  capsid_protein_VP1__Norovirus__AFX81247
augaagauggcgucgagugacgccaacccaucugauggguccacagccaaccuugucccagaggucaauaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggacgucacccauauuccaggcagucguaacuacacaaugaauuuggccucccaaaauugggacaguuacgauccaacagaagaaaccccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguagcaccaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggacuuggacugccugcucccccaggaaugggugcaauauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 4470 - RNA, 1623 nt, Artificial Sequence
  capsid_protein_VP1__Norovirus__AFX81250
augaagauggcgucgagugacgccaacccaucuaauggguccacagccaaccuugucccagagguuaauaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggacgucacccauauuccaagcagucauaacuacacaaugaauuuggccucccaaaauuggaacaguuacgauccaacagaagaaaucccagccccucuaggaacuccagauuucguggggaagauucaaggugugcucacccaaaccacaaggacagauggcucgacccgcggccacaaagcuacaguguacacugggagcgccgacuuuucuccaaaacuggguagaguucaauuugccacugacacagacaaugauuuccaaacuaaccaaaacacaaaguucaccccagucgguguuauccaggaugguaguaccaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggacuuggacugucugcucccccaggaaugggugcaauauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 4471 - RNA, 1623 nt, Artificial Sequence; identical to SEQ ID NO: 4468
  capsid_protein_VP1__Norovirus__AFX81253

SEQ ID NO: 4472 - RNA, 1623 nt, Artificial Sequence
  capsid_protein_VP1__Norovirus__AFX81256
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuauucaggcagaaacauucacaaugugcaccuagccccugcuguagcccccacuuuuccgggugagcagcuccucuucuucagaucuacuaugcccggaugcagcggguaccccaacauggacuuggacugucugcucccccaggaaugggugcaguauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 4473 - RNA, 1623 nt, Artificial Sequence
  capsid_protein_VP1__Norovirus__AFX81262
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucccauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguggcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4474 - RNA, 1623 nt, Artificial Sequence
  capsid_protein_VP1__Norovirus__AFX81265
augaagauggcgucgaaugacgccaacccaucugauggguccgcagccaaccucgucccagaggucagcaaugagguuauggcuuuggaacccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucaccauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcagaugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccaccaugcccggaugcagcggguaucccaacauggauuuggauugccuacucccccaggagugggugcagcacuucuaccaagaggcagcuccagcacaaucugauguggcucuacugagauuugugaauccagacacggguaggguccuguuugagugcaaacuucauaaaucagguuaugucacaguggcucacaccggucagcaugauuuggucaucccccccaauggcuauuuuagguuugauuccuggguuaaucaauuuuacacacuugcccccaugggaaacggaacggggcguaggcgcgcuuuauga

SEQ ID NO: 4475 - RNA, 1623 nt, Artificial Sequence
  capsid_protein_VP1__Norovirus__AFX81268
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucccauuuggccagaauguauaaugguuaugcaggugguuuugaagugcgggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggccccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagcccccgcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4476 - RNA, 1623 nt, Artificial Sequence
  capsid_protein_VP1__Norovirus__AFX81271
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccuugcggggaacgcguucaccgccggaaaaauuauauuugcagcagucccaccaaacuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuucccauuccuuuggaaaagcuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacccaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggauguagcggguaucccaacauggauuuggauugccuacucccccaggagugggugcagcacuucuaccaagaggcagcuccagcacagucugauguggcucuauugagauuugugaauccagacacggguaggguccuguuugagugcaaacuucauaaaucaggcuaugucacaguggcccacaccggucagcaugauuuggucaucccccccaauggcuauuuuagguuugauuccuggguuaaucaguucuacacacuugcccccaugggaaacggaacggggcguaggcgcgcuuuauaa

SEQ ID NO: 4477 - RNA, 1623 nt, Artificial Sequence
  capsid_protein_VP1__Norovirus__AFX81274
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucccauuuggccagaauguauaaugguuaugcaggugguuuugaagugcgggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaauuguucacgggccccagcggugccuuuguuguccaaccacaaaauggcaggugcacgacugauggcgugcucuuaggcaccacccaacugucuccugucagcaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagcccccgcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4478 - RNA, 1623 nt, Artificial Sequence; identical to SEQ ID NO: 4475
  capsid_protein_VP1__Norovirus__AFX81277

SEQ ID NO: 4479 - RNA, 1623 nt, Artificial Sequence
  capsid_protein_VP1__Norovirus__AFX81283
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucccauuuggccagaauguauaaugguuaugcaggugguuuugaagugcaggugauccucgcggggaacgcguucaccgcgggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccagucaacaucugcaccuucagaggggaugucacccacauugcagguucucguaauuacacaaugaauuuggcaucucuaaauuggaacaauuaugacccaacagaagaaauuccagccccucuggggacuccagauuucgugggaaagauccaaggugugcucacacaaaccacaaaaggagauggcucgacccguggccacaaagcuacaguuuacacugggagugcccccuuuacuccaaagcugggcaguguucaauucaguacugacacagaaaaugauuuugaaacucaccaaaacacaaaauucaccccagucggugucauccaggaugguagcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4480 - RNA, 1623 nt, Artificial Sequence
  capsid_protein_VP1__Norovirus__AFX81289
augaagauggcgucgaaugacgccaacccaucugauggguccgcagccaaccucgucccagaggucagcaaugagguuauggcuuuggagcccguugucggugccgccauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucccauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcuuuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4481 - RNA, 1623 nt, Artificial Sequence
  capsid_protein_VP1__Norovirus__AFX81292
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaagugcaggugauccuugcggggaacgcguucaccgccggaaaaauuauauuugcagcagucccaccaaacuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccgcccacaguugagucaagaacuaaaccauuuacugucccaaucuuaaccguugaagaaaugaccaauucaagauuucccauuccuuuggaaaaguuguucacgggucccagcggugccuuuguuguccaaccacaaaauggcaggugcacgacugauggcgugcucuuagguaccacccaacugucuccugucaacaucugcaccuucagaggggaugucacccacauugcaggaucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaaacugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggauguagcggguaucccaacauggauuuggauugccuacucccccaggagugggugcagcacuucuaccaagaggcagcuccagcacagucugauguggcucuauugagauuugugaauccagacacggguaggguccuguuugagugcaaacuucauaaaucaggcuaugucacaguggcccacaccggucagcaugauuuggucaucccccccaauggcuauuuuagguuugauuccuggguuaaucaguucuacacacuugcccccaugggaaacggaacggggcguaggcgcgcuuuauaa

SEQ ID NO: 4482 - RNA, 1623 nt, Artificial Sequence
  capsid_protein_VP1__Norovirus__AFX81295
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaacgcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugcuuuuguuguccaaccacaaaauggcaggugcacgacugauggugugcucuuaggcaccacccaacugucucccgucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4483 - RNA, 1623 nt, Artificial Sequence
  capsid_protein_VP1__Norovirus__AFX81298
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccuugcggggaacgcguucaccgccggaaaaauuauauuugcagcagucccaccaaacuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuucccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcaggaucucguaauuacacaaugaauuuggcaucucuaaauuggaacaauuaugacccaacagaagaaauuccagccccucugggaacuccagauuucgugggaaagauccaaggugugcucacccaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggauguagcggguaucccaacauggauuuggauugccuacucccccaggagugggugcagcacuucuaccaagaggcagcuccagcacagucugauguggcucuauugagauuugugaauccagacacggguaggguccuguuugagugcaaacuucauaaaucaggcuaugucacaguggcccacaccggucagcaugauuuggucaucccccccaauggcuauuuuagguuugauuccuggguuaaucaguucuacacacuugcccccaugggaaacggaacggggcguaggcgcgcuuuauaa

SEQ ID NO: 4484 - RNA, 1623 nt, Artificial Sequence
  capsid_protein_VP1__Norovirus__AFX81301
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaccugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaacaacuucuaucacuauaaccagucaaaugauucuaccauuaaacugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagguuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaacuggaacaauuaugacccaacagaagaaauuccagcuccucuaggaacuccagauuucgugggaaagauccaaggugugcucacucaaaccacaaagggagaugguucgacccguggccauaaagccacaguuuacacugggagugcccccuuuacuccaaagcugggcaguguucaauucagcaccgacacagaaaaugauuuugaaacucaccaaaacacaaaauucaccccagucggcgucauccaggaugguagcaccacccaccgaaaugaaccucaacaaugggugcucccaaguuauucagguagaaaugucccuaauguacaccuagccccugcuguagcccccacuuuuccgggugaacaacuucucuucuuuagguccacuaugcccggaugcagcggguaucccaacauggauuuggauugccuacucccccaggagugggugcagcacuucuaccaagaggcagcuccagcacaaucugauguggcucuauuaagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 4485 - RNA, 1623 nt, Artificial Sequence
  capsid_protein_VP1__Norovirus__AFX81304
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauucucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcuggguaguguucaauucaguacugacacagaaaaugauuuugaaacucaccaaaacacaaaauucaccccagucggugucauccaggaugguggcaccacccaccgaaaugaaccccaacagugggugcucccaaguuauucagguagagauguucauaaugugcaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4486 - RNA, 1623 nt, Artificial Sequence
  capsid_protein_VP1__Norovirus__AFX81307
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucaccauguucccccacauaauaguagauguuaggcaauuggaaccuguguugauccccuuaccugauguuaggaauaauuuuuaucauuauaaucagacaaaugauucuaccauuaaauugauagcaaugcuguauacaccacuuagggccaauaacgcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugcuuuuguuguccaaccacaaaauggcaggugcacgacugauggcgugcucuuaggcaccacccaacugucucccgucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4487 - RNA, 1623 nt, Artificial Sequence
  capsid_protein_VP1__Norovirus__AFX81313
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauucucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucagacaaaugauucuaccauuaaauugauagcaaugcuguauacaccacuuagggccaauaaugcuggggaagaugucuuuacagucucuugucgaguccucacuaggccguccccugauuuugauuuuauauuuuuggugccacccacaguugagucaagaacuaaaccauuuacugucccaaucuuaaccguugaagaaaugaccaacucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggucauaaagcuacaguuuacacugggagugcccccuuuacuccaaagcuggguaguguucaauucaguacugacacagaaaaugauuuugaaacucaccaaaacacaaaauucaccccagucggugucauccaggaugguggcaccacccaccgaaaugaaccccaacagugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4488 - RNA, 1623 nt, Artificial Sequence
  capsid_protein_VP1__Norovirus__AFX81316
augaagauggcgucgaaugacgccaacccaucugauggguccgcagccaaccucgucccagaggucagcaaugagguuauggcuuuggaacccguugucggugccgcuauugcggcgccuguagcgggccaacaaaacguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucagacaaaugauucuaccauuaaauugauagcaaugcuguauacaccacuuagggccaauaaugcuggggaagaugucuuuacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4489 - RNA, 1623 nt, Artificial Sequence; identical to SEQ ID NO: 4488
  capsid_protein_VP1__Norovirus__AFX81319

SEQ ID NO: 4490 - RNA, 1623 nt, Artificial Sequence
  capsid_protein_VP1__Norovirus__AFX81322
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauucucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucagacaaaugauucuaccauuaaauugauagcaaugcuguauacaccacuuagggccaauaaugcuggggaagauguuuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagacggcucgacccguggccauaaagcuacaguuuacacugggagugcccccuuuacuccaaagcuggguaguguucaauucaguacugacacagaaaaugauuuugaaacucaccaaaacacaaaauucaccccagucggugucauccaggaugguggcaccacccaccgaaaugaaccccaacagugggugcucccaaguuauucagguagagauguucauaaugugcaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuccauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4491 - RNA, 1623 nt, Artificial Sequence
  capsid_protein_VP1__Norovirus__AFX81325
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaucuaucccauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccagcaaugggugcucccaaguuauucagguagagauguucauaauguacaccuagccccugcuguggcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4492 - RNA, 1623 nt, Artificial Sequence
  capsid_protein_VP1__Norovirus__AGE89433
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccauauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaacuacacaaugaacuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaauacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuguugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4493 - RNA, 1623 nt, Artificial Sequence
  capsid_protein_VP1__Norovirus__AGE89436
augaagauggcgucgaaugacgccaacccaucugauggguccgcagccaaccucgucccagaggucagcaaugagguuauggcuuuggaacccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucccauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacacuugcccccaugggaaacggaacggggcguaggcgcgccuuauaa

SEQ ID NO: 4494 - RNA, 1623 nt, Artificial Sequence
  capsid_protein_VP1__Norovirus__AGE89439
augaagauggcgucgagugacgccaacccaucugauggguccacagccaaccuugucccagaggucaacaaugagguuauggcuuuggagcccguaguuggugccgccauugcggcacccguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuugacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggacgucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaagcuacucaggcagaaacauucauaaugugcaccuggcccccgcuguagcccccacuuucccgggcgagcagcuccucuucuucagaucuacuaugcccggaugcagcggguaccccaacauggacuuggacugucugcucccccaggaaugggugcaauauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 4495 - RNA, 1623 nt, Artificial Sequence
  capsid_protein_VP1__Norovirus__AGE89442
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaagcaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggaaaugaccaauucaagguuccccaucccuuuggaaaaguuguucacgggccccaguagugccuuuguuguucaaccacaaaacggcaggugcacgaccgauggcgugcuccuagguacuacccaacugucucccgucaacaucugcaccuucagaggggacgucacccauauuccaggcagucguaacuacacaaugaauuuggccucccaaaauuggaacaguuacgacccaacagaagaaaucccagccccucuaggaacuccagauuucguggggaagauucaaggugugcucacccaaaccacaaggacagauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccacccaccgaaaugaaccccaacaaugggugcucccaaguuauucagguagagauguucauaauguacaccuagccccugcuguagcccccacuuucccgggcgagcagcuccucuucuucagaucuacuaugcccggaugcagcggguaccccaacauggacuuggacugucugcucccccaggaaugggugcaauauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 4496 - RNA, 1623 nt, Artificial Sequence
  capsid_protein_VP1__Norovirus__AGE89445
augaagauggcgucgagugacgccaacccaucugauggguccacagccaaccuugucccagaggucaauaaugagguuauggcuuuggagcccguaguuggugccgccauugcggcaccuguagcgggccaacaaaauguaauugaccccuggauuagaagcaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaacuucccaacugaagguuugagccccagccaggucacuauguucccccacauaauaguagauguuaggcaauuggaaccuguguugauucccuuacccgauguuaggaauaauuucuaucauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagcgccuuuguuguucaaccacaaaacggcaggugcacgacugauggcgugcuccuagguacuacccaacugucucccgucaacaucugcaccuucagaggggacgucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguagcaccaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggacuuggacugucugcucccccaggaaugggugcaauauuucuaccaggaggcagccccagcacaaucugauguggcucugcuaagauuugugaauccggacacugguaggguuuuguuugaguguaagcuucauaaaucaggcuauguuacaguggcucacacuggccaacaugauuugguuaucccccccaaugguuauuuuagauuugauuccuggguuaaccaguucuacacacuugcccccaugggaaaugggacggggcguagacgugcauuauaa

SEQ ID NO: 4497 - RNA, 1623 nt, Artificial Sequence
  capsid_protein_VP1__Norovirus__AGE89448
augaagauggcgucgagugacgccaacccaucugauggguccacagccaaccuugucccagaggucaauaaugagguuauggcuuuggagcccguaguuggugccgccauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcaaguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggacgucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucauaaugugcaccuggcccccgcuguagccccuacuuucccgggcgagcagcuccucuucuucagaucuacuaugcccggaugcagcggguaccccaacauggacuuggacugucugcucccccaggaaugggugcaauauuucuaccaggaggcagccccagcacaaucugauguggcucugcuaagauuugugaauccugacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 4498 - RNA, 1623 nt, Artificial Sequence
  capsid_protein_VP1__Norovirus__AGE89451
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaaucauauuugcagcagucccaccaaauuuuccaacugaaggccugagucccagccaggucaccauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaacgcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugcuuuuguuguccaaccacaaaauggcaggugcacgacugauggcgugcucuuaggcaccacccaacugucucccgucaacaucugcaccuucagaggggaugucacccacauugcagguucucguaauuacacaaugaauuuggcaucucuaaauuggaacaauuacgacccaacagaagaaauuccagccccucugggaacuccagauuuugugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4499 - RNA, 1623 nt, Artificial Sequence
  capsid_protein_VP1__Norovirus__AGE89454
augaagauggcgucgaaugacgccaacccaucugauggguccgcagccaaccucgucccagaggucagcaaugagguuauggcuuuggaacccguugucggugccgcuauugcggcgccuguagcgggccaacaaaauguaauugaccccuggauuagaaauaauuuuguacaagccccugguggagaguucacaguauccccuagaaacgcuccaggugaaauacuauggggcgcgcccuuaggcccugaccugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcagaugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccaccaugcccggaugcagcggguaucccaacauggauuuggauugccuacucccccaggagugggugcagcacuucuaccaagaggcagcuccagcacaaucugauguggcucuacugagauuugugaauccagacacggguaggguccuguuugagugcaaacuucauaaaucagguuaugucacaguggcucacaacggucagcaugauuuggucaucccccccaauggcuauuuuagguuugauuccuggguuaaucaauucuacacacuugcccccaugggaaacggaacggggcguaggcgcgcuuuauaa

SEQ ID NO: 4500 - RNA, 1623 nt, Artificial Sequence
  capsid_protein_VP1__Norovirus__AGE89457
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccuugcggggaacgcguucaccgccggaaaaauuauauuugcagcagucccaccaaacuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcaggaucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggauguagcggguaucccaacauggauuuggauugccuacucccccaggagugggugcagcacuucuaccaagaggcagcuccagcacagucugauguggcucuauugagauuugugaauccagacacggguaggguccuguuugagugcaaacuucauaaaucaggcuaugucacaguggcccacaccggucagcaugauuuggucaucccccccaauggcuauuuuagguuugauuccuggguuaaucaguucuacacacuugcccccaugggaaacggaacggggcguaggcgcgcuuuauaa

SEQ ID NO: 4501 - RNA, 1623 nt, Artificial Sequence
  capsid_protein_VP1__Norovirus__AGE89460
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccuugcggggaacgcguucaccgccggaaaaauuauauuugcagcagucccaccaaacuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuucccauuccuuuggaaaaguuauucacgggucccagcggugccuuuguuguccaaccacaaaauggcaggugcacgacugauggcgugcucuuaggcaccacccaacugucuccugucaacaucugcaccuucagaggggaugucacccacauugcaggaucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggauguagcggguaucccaacauggauuuggauugccuacucccccaggagugggugcagcacuucuaccaagaggcagcuccagcacagucugauguggcucuauugagauuugugaauccagacacggguaggguccuguuugagugcaaacuucauaaaucaggcuaugucacaguggcccacaccggucagcaugauuuggucaucccccccaauggcuauuuuagguuugauuccuggguuaaucaguucuacacacuugcccccaugggaaacggaacggggcguaggcgcgcuuuauaa

SEQ ID NO: 4502 - RNA, 1623 nt, Artificial Sequence
  capsid_protein_VP1__Norovirus__AGE89463
augaagauggcgucgaaugacgccaacccaucugauggguccgcagccaaccucgucccagaggucagcaaugagguuauggcucuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucagacaaaugauucuaccauuaaauugauagcaaugcuguauacaccacuuagggccaauaaugcuggggaagaugucuuuacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4503 - RNA, 1623 nt, Artificial Sequence
  capsid_protein_VP1__Norovirus__AGE89466
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucagacaaaugauucuaccauuaaauugauagcaaugcuguauacaccacuuagggccaauaaugcuggggaagaugucuuuacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4504 - RNA, 1623 nt, Artificial Sequence
  capsid_protein_VP1__Norovirus__AGE89472
augaagauggcgucgaaugacgccaacccaucugauggguccgcagccaaccucgucccagaggucagcaaugagguuauggcuuuggaacccguugucggugccgcuauugcggcgccuguagcgggccaacaaaauguaauugaccccuggauuagaaauaauuuuguacaagccccugguggagaguucacaguauccccuagaaacgcuccaggugaaauacuauggggcgcgcccuuaggcccugaccugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccucuggaaaaguuguucacgggucccagcggugccuuuguuguccaaccacaaaauggcagaugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccaccaugcccggaugcagcggguaucccaauauggauuuggauugccuacucccccaggagugggugcagcacuucuaccaagaggcagcuccagcacaaucugauguggcucuacugagauuugugaauccagacacggguaggguccuguuugagugcaaacuucauaaaucagguuaugucacaguggcucacaacggucagcaugauuuggucaucccccccaauggcuauuuuagguuugauuccuggguuaaucaauucuacacacuugcccccaugggaaacggaacggggcguaggcgcgcuuuauaa

SEQ ID NO: 4505 - RNA, 1623 nt, Artificial Sequence
  capsid_protein_VP1__Norovirus__AGE89475
augaagauggcgucgaaugacgccaacccaucugauggguccgcagccaaccucgucccagaggucagcaaugagguuauggcuuuggaacccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcgggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucagacaaaugauucuaccauuaaauugauagcaaugcuguauacaccacuuagggccaauaaugcuggggaagaugucuuuacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4506 - RNA, 1623 nt, Artificial Sequence
  capsid_protein_VP1__Norovirus__AGE89478
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauucucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugaugucaggaauaacuucuaucauuauaaucagacaaaugauucuaccauuaaauugauagcaaugcuguauacaccacuuagggccaauaaugcuggggaagaugucuuuacagucucuugucgaguccucacuaggccguccccugauuuugauuuuauauuuuuggugccacccacaguugagucaagaacuaaaccauuuacugucccaaucuuaaccguugaagaaaugaccaacucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggucauaaagcuacaguuuacacugggagugcccccuuuacuccaaagcuggguaguguucaauucaguacugacacagaaaaugauuuugaaacucaccaaaacacaaaauucaccccagucggugucauccaggaugguggcaccacccaccgaaaugaaccccaacagugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4507 - RNA, 1623 nt, Artificial Sequence
  capsid_protein_VP1__Norovirus__AGE89481
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaucuaucccauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaagaagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguggcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4508 - RNA, 1623 nt, Artificial Sequence; identical to SEQ ID NO: 4503
  capsid_protein_VP1__Norovirus__AGE89490

SEQ ID NO: 4509 - RNA, 1623 nt, Artificial Sequence; identical to SEQ ID NO: 4449
  capsid_protein_VP1__Norovirus__AGE89493

SEQ ID NO: 4510 - RNA, 1623 nt, Artificial Sequence
  capsid_protein_VP1__Norovirus__AGE89496
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaucuaucccauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccagcaaugggugcucccaaguuauucagguagagauguucauaauguacaccuagccccugcuguggcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaccaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4511 - RNA, 1623 nt, Artificial Sequence
  capsid_protein_VP1__Norovirus__AGE89499
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaacgcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaacucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaaccccagauuucgugggaaagauccaaggugugcucacucaaaccacaaaaggagauggcucgacccguggucauaaagcuacaguuuacacugggagugcccccuuuacuccaaagcuggguaguguucaauucaguacugacacagaaaaugauuuugaaacucaccaaaacacaaaauucaccccagucggugucauccaggaugguggcaccacccaccgaaaugaaccccaacagugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4512 - RNA, 1623 nt, Artificial Sequence
  capsid_protein_VP1__Norovirus__AGE89502
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaacgcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugcuuuuguuguccaaccacaaaauggcaggugcacgacugauggcgugcucuuaggcaccacccaacugucucccgucaacaucugcgccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4513 - RNA, 1623 nt, Artificial Sequence
  capsid_protein_VP1__Norovirus__AGE89505
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcagggaacgcguucaccgccggaaaaauuauauuugcagcagucccaccaaacuuuccaacugaaggccugagucccagccaggucacuauguucccccacauaauaguagauguuaggcaauuggaaccuguguugauccccuuaccugauguuaggaauaacuucuaucauuauaaucagacaaaugauucuaccauuaaauugauagcaaugcuguauacaccacuuagggccaauaaugcuggggaagaugucuuuacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4514 - RNA, 1623 nt, Artificial Sequence
  capsid_protein_VP1__Norovirus__AGE89508
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuaggaauaauuuuguacaagccccugguggagaauucacaguauccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcaguuccaccaaauuuuccaacugaaggcuugagccccagccagguuacuauguucccccacauaauaguagauguuaggcaacuggagccuguguugauccccuuaccugauguuaggaauaacuucuaucauuauaaucagucaaaugauucuaccauuaaacugauagcaaugcuguacacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccaucccuuuggaaaaguuguucacgggccccagcggugccuuuguuguucaaccacaaaaugguagaugcacgacugauggcgugcucuuaggcaccacccaacugucuccugucaacaucugcaccuucagaggggaugucacccacauugcagguucucgcgauuacacgaugaauuuggcuucucuaaauuggaauaauuaugacccaacagaagaaauuccagccccucugggaacuccagauuucgugggaaagauccaaggugugcucacucaaaccacaaagggagauggcucgacccguggccauaaagcuacaguuuacacugggagugcccccuuuacuccaaagcugggcaguguccaauucaguacugacacagaaaaugauuuugaagcucaccaaaacacaaaauucaccccagucggugucauccaggaugguggcaccacccaccgaaaugaaccccaacaaugggugcucccaaguuauucagguagagauguccacaauguacaccuggccccugcuguagcccccacuuuuccgggugaacaacuucuuuucuucagguccacuaugcccggaugcaguggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 4515 - RNA, 1623 nt, Artificial Sequence
  capsid_protein_VP1__Norovirus__AGE89511
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaacgcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugcuuuuguuguccaaccacaaaauggcaggugcacgacugauggcgugcucuuaggcaccacccaacugucucccgucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuccauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4516 - RNA, 1623 nt, Artificial Sequence
  capsid_protein_VP1__Norovirus__AGE89514
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaacgguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauuaauagcaaugcuguauacaccacuuagggccaauaacgcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugcuuuuguuguccaaccacaaaauggcaggugcacgacugauggcgugcucuuaggcaccacccaacugucucccgucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4517 - RNA, 1623 nt, Artificial Sequence
  capsid_protein_VP1__Norovirus__AGE89517
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauucucgcggggaacgcguucaccgccggaaaaauuauauuugcagcagucccaccaaacuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaaugcuggggaagaugucuuuacagucucuugucgaguccucacuaggccguccccugauuuugauuuuauauuuuuggugccacccacaguugagucaagaacuaaaccauuuaccgucccaaucuuaaccguugaagaaaugaccaacucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggucauaaagcuacaguuuacacugggagugcccccuuuacuccaaagcuggguaguguucaauucaguacugacacagaaaaugauuuugaaacucaccaaaacacaaaauucaccccagucggugucauccaggaugguggcaccacccaccgaaaugaaccccaacagugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4518 - RNA, 1623 nt, Artificial Sequence; identical to SEQ ID NO: 4512
  capsid_protein_VP1__Norovirus__AGE89520

SEQ ID NO: 4519 - RNA, 1623 nt, Artificial Sequence
  capsid_protein_VP1__Norovirus__AGE89523
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucagacaaaugauucuaccauuaaauugauagcaaugcuguauacaccacuuagggccaauaaugcuggggaagaugucuuuacagucucuugucgaguccucacuaggccguccccugauuuugauuuuauauuuuuggugccacccacaguugagucaagaacuaaaccauuuacugucccaaucuuaaccguugaagaaaugaccaauucaagauuucccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuucacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4520 - RNA, 1623 nt, Artificial Sequence; identical to SEQ ID NO: 4449
  capsid_protein_VP1__Norovirus__AGE89526

SEQ ID NO: 4521 - RNA, 1623 nt, Artificial Sequence
  capsid_protein_VP1__Norovirus__AGE89529
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguaucuccuagaaacgcuccaggugaaauacuauggagcgcgcccuuaggcccugaucugaaucccuaucuaucccauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaagaagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguggcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4522 - RNA, 1623 nt, Artificial Sequence
  capsid_protein_VP1__Norovirus__AGE89532
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauucucgcgggaaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggacgucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagacggcucgacccguggccauaaagcuacgguuuacacugggagugcccccuuuacuccaaagcuggguaguguucaauucaguacugacacagaaaaugauuuugaaacucaccaaaacacaaaauucaccccagucggugucauccaggaugguggcaccacccaccgaaaugaaccccaacagugggugcucccaaguuauucagguagagauguucauaaugugcaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuauacgcuugcccccaugggaaacggaacggggcguaggcgcgccuuauaa

SEQ ID NO: 4523 - RNA, 1623 nt, Artificial Sequence
  capsid_protein_VP1__Norovirus__AGE89535
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucccauuuggccagaauguauaaugguuaugcaggugguuuugaagugcgggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguggcccccacuuuuccgggugaacaacuucuuuucuucagguccacuaugcccggaugcagcggguaucccaacauggauuuggauugccuacucccccaagagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4524 - RNA, 1623 nt, Artificial Sequence
  capsid_protein_VP1__Norovirus__AGE89538
augaagauggcgucgaaugacgccaacccaucugauggguccgcagccagccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaucuaucccauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguggcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugaugcggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4525 - RNA, 1623 nt, Artificial Sequence
  capsid_protein_VP1__Norovirus__AGE89541
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaucuaucccauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguggcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4526 - RNA, 1623 nt, Artificial Sequence
  capsid_protein_VP1__Norovirus__AGE89544
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucccauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacccaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguggcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcucgcccccaugggaaacggaacggggcguaggcgcgccuuauaa

SEQ ID NO: 4527 - RNA, 1623 nt, Artificial Sequence
  capsid_protein_VP1__Norovirus__AGE89547
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucagacaaaugauucuaccauuaaauugauagcaaugcuguauacaccacuuagggccaauaaugcuggggaagaugucuuuacagucucuugucgaguccucacuaggccguccccugauuuugauuuuauauuuuuggugccacccacaguugagucaagaacuaaaccauuuacugucccaaucuuaaccguugaagaaaugaccaauucaagauuucccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguagcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuacuuuagguuugauuccuggguuaaucaguucuacacgcuugcccccaugggaaacggaacggggcguaggcgcgccuuauaa

SEQ ID NO: 4528 - RNA, 1623 nt, Artificial Sequence
  capsid_protein_VP1__Norovirus__AGE89550
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaacgcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugcuuuuguuguccaaccacaaaauggcaggugcacgacugauggcgugcucuuaggcaccacccaacugucucccgucaacaucugcaccuucagaggggaugucacccacauugcagguucucgugauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuccauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4529 - RNA, 1623 nt, Artificial Sequence
  capsid_protein_VP1__Norovirus__AGE89553
augaagauggcgucgaaugacgccaacccaucugauggguccgcagccaaccucgucccagaggucaacaaugagguuauggcuuuggagcccguugucggugccgcuauugcggcgccuguagcgggccagcaaaauguaauugaccccuggauuaggaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauucgcagcaguuccaccaaauuuuccaacugaaggcuugagccccagccagguuacuauguucccccacauaauaguagauguuaggcaacuggaaccuguguugauccccuuaccugauguuaggaauaacuucuaucauuauaaucagucaaaugauucuaccauuaaguugauagcaaugcuguacacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccaucccuuuggaaaaguuguucacgggccccagcggugccuuuguuguucaaccgcaaaaugguaggugcacgacugauggcgugcucuuaggcaccacccaacugucuccugucaacaucugcaccuucagaggggaugucacccacauugcagguucucgcaauuacacgaugaauuuggcuucucuaaauuggaacaauuaugacccaacagaagaaauuccagccccucugggaacuccagauuucgugggaaagauccaaggugugcucacucaaaccacaaagggagauggcucgacccguggccauaaagcuacaguuuacacugggagugcccccuuuacuccaaagcugggcaguguccaauucagcacugauacagaaaaugauuuugaagcucaccaaaacacaaaauucaccccagucggugucauccaggaugguggcaccacccaccgaaaugaaccccaacaaugggugcucccaagcuauucagguagagauguccacaauguacaccuggccccugcuguagcccccacuuuuccgggugaacaacuucuuuucuucagguccacuaugcccggaugcaguggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacacuggccagcaugauuuggucaucccccccaauggcuauuuuagguuugauuccuggguuaaucaauucuacacacuugcccccaugggaaauggaacggggcguagacgugcuuuauaa

SEQ ID NO: 4530 - RNA, 1623 nt, Artificial Sequence
  capsid_protein_VP1__Norovirus__AGE89556
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaucuaucccauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugaucccuuuaccugauguuaggaauaacuucuaucauuauaaucaaacaaaugauucuaccauuaaguugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuauacaaugaauuuggcaucucuaaauuggaacaauuaugacccaacagaagaaauuccagccccucugggaacuccagauuucgugggaaagauccaaggugugcucacucaaaccacaaaagaagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguggcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4531 - RNA, 1623 nt, Artificial Sequence
  capsid_protein_VP1__Norovirus__AGE89559
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaucuaucccauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaagaagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguggcccccacuuuuccgggugaacaaauucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4532 - RNA, 1623 nt, Artificial Sequence
  capsid_protein_VP1__Norovirus__AGE89562
augaagauggcgucgaaugacgccaacccaucugauggguccgcagccagccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaagucacuauguucccccacauaauaguagauguuaggcaauuggaaccuguguugauccccuuaccugauguuaggaauaacuucuaucauuauaaucagacaaaugauccuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccacaaagcuacaguuuacacugggagugcccccuuuacuccaaagcugggcaguguucaauucaguacugacacagaaaaugauuuugaaacucaccaaaacacaaaauucaccccaguugguguuauccaggaugguggcaccacccaccgaaaugaaccccaacaaugggugcucccaagcuauucagguagagauguucauaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcgcaaucugauguggcucuauuaagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4533 - RNA, 1623 nt, Artificial Sequence
  capsid_protein_VP1__Norovirus__AGE89565
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucccauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaacucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaacuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucacaauguacaccuagccccugcuguggcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaccaguucuacacgcuugcccccaugggaaacggaacggggcguaggcgcgccuuauaa

SEQ ID NO: 4534 - RNA, 1623 nt, Artificial Sequence; identical to SEQ ID NO: 4459
  capsid_protein_VP1__Norovirus__AGE89568

SEQ ID NO: 4535 - RNA, 1623 nt, Artificial Sequence; identical to SEQ ID NO: 4461
  capsid_protein_VP1__Norovirus__AGE89571

SEQ ID NO: 4536 - RNA, 1623 nt, Artificial Sequence
  capsid_protein_VP1__Norovirus__AGE89574
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucagacaaaugauucuaccauuaaauugauagcaaugcuguauacaccacuuagggccaauaaugcuggggaagaugucuuuacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagccacaguuuacacugggagugcccccuuuacuccaaagcugggcaguguucaauucaguacugacacagaaaaugauuuugaaacucaucaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4537 - RNA, 1623 nt, Artificial Sequence
  capsid_protein_VP1__Norovirus__AGE89577
augaagauggcgucgaaugacgccaacccaucugauggguccgcagccaaccucgucccagaggucagcaaugagguuauggccuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaacgcuggggaagaugucuucacagucucuugucgaguccucacuaggccguccccugauuuugauuuuauauuuuuggugccacccacaguugagucaagaacuaaaccauuuacugucccaauuuuaaccguugaagaaaugaccaauucaagauuccccauuccuuuggaaaaguuguucacgggucccagcggugcuuuuguuguccaaccacaaaauggcaggugcacgacugauggugugcucuuaggcaccacccaacugucucccgucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcuaggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4538 - RNA, 1623 nt, Artificial Sequence
  capsid_protein_VP1__Norovirus__AGE89580
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauuaauagcaaugcuguauacaccacuuagggccaauaacgcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugcuuuuguuguccaaccacaaaauggcaggugcacgacugauggcgugcucuuaggcaccacccaacugucucccgucaacaucugcaccuucagaggggaugucacccacauugcagguucucgugauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggaucuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4539 - RNA, 1623 nt, Artificial Sequence
  capsid_protein_VP1__Norovirus__AGE89583
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaacgcuggggaagaugucuucacagucucuugucgaguccucacuaggccguccccugauuuugauuuuauauuuuuggugccacccacaguugagucaagaacuaaaccauuuacugucccaauuuuaaccguugaagaaaugaccaauucaagauuccccauuccuuuggaaaaguuguucacgggucccagcggugcuuuuguuguccaaccacaaaauggcaggugcacgacugauggugugcucuuaggcaccacccaacugucucccgucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcuaggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4540 - RNA, 1623 nt, Artificial Sequence
  capsid_protein_VP1__Norovirus__AGE89586
augaagauggcgucgaaugacgccaacccaucugauggguccgcagccaaccucgucccagaggucagcaaugagguuauggcuuuggagcccguugucggagccgcuauugcggcgccuguagcgggccaacaaaauguaauugaccccuggauuagaaacaauuuuguacaagccccugguggagaguucacaguauccccuagaaacgcuccaggugaaauauuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaagucacuauguucccccacauaauaguagauguuaggcaauuggaaccuguguugauccccuuaccugauguuaggaauaacuucuaucauuauaaucagacaaaugauccuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaauccuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaguuccagccccucugggaacuccagauuucgugggaaagauccaaggugugcucacucaaaccacaaaaggagauggcucgacccguggccacaaagcuacaguuuacacugggagugcccccuuuacuccaaagcugggcaguguucaauucaguacugacacagaaaaugauuuugaaacucaccaaaacacaaaauucaccccaguugguguuauccaggaugguggcaccacccaccgaaaugaaccccaacaaugggugcucccaagcuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcgcaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4541 - RNA, 1623 nt, Artificial Sequence
  capsid_protein_VP1__Norovirus__AGE89589
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaacgcuggggaagaugucuucacagucucuugucgaguccucacuaggccguccccugauuuugauuuuauauuuuuggugccacccacaguugagucaagaacuaaaccguuuacugucccaauuuuaaccguugaagaaaugaccaauucaagauuccccauuccuuuggaaaaguuguucacgggucccagcggugcuuuuguuguccaaccacaaaauggcaggugcacgacugauggugugcucuuaggcaccacccaacugucucccgucaacaucugcaccuucagaggggaugucacccacauugcagguucucguaauuacacaaugaauuuggcaucucuaaauuggaacaauuaugacccaacagaagaaauuccagccccucuggggacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguggcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagguuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4542 - RNA, 1623 nt, Artificial Sequence
  capsid_protein_VP1__Norovirus__AGE89592
augaagauggcgucgaaugacgccaacccaucugauggguccgcagccaaccucgucccagaggucagcaaugagguuauggcuuuggaacccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccuugcggggaacgcguucaccgccggaaaaauuauauuugcagcagucccaccaaacuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuucccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagccacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucugguagagauguucauaauguacaccuagccccugcuguagcccccacuuuuccgggugaacaacuucuuuucuucagguccacuaugcccggauguagcggguaucccaacauggauuuggauugccuacucccccaggagugggugcagcacuucuaccaagaggcagcuccagcacagucugauguggcucuauugagauuuguaaauccagacacggguaggguccuguuugagugcaaacuucauaaaucaggcuaugucacaguggcccacaccggucagcaugauuuggucaucccccccaauggcuauuuuagguuugauuccuggguuaaucaguucuacacacuugcccccaugggaaacggaacggggcguaggcgcgcuuuauaa

SEQ ID NO: 4543 - RNA, 1623 nt, Artificial Sequence
  capsid_protein_VP1__Norovirus__AGE89595
augaagauggcgucgagugacgccaacccaucugauggguccacagccaaccuugucccagaggucaacaaugagguuauggcuuuggagcccguaguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccaccuacagucgaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucacaaugugcaccuggcccccgcuguagcccccacuuucccgggcgagcagcuccucuucuucagaucuacuaugcccggaugcagcggguaccccaacauggacuuggacugucugcucccccaggaaugggugcaguauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcgcagacgugcauuauaa

SEQ ID NO: 4544 - RNA, 1623 nt, Artificial Sequence
  capsid_protein_VP1__Norovirus__AGE89598
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaauguuguacacaccacuuagggccaauaacgcuggggaagaugucuucacagucucuugucgaguccuuacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugcuuuuguuguccaaccacaaaauggcaggugcacgacugauggcgugcucuuaggcaccacccaacugucucccgucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucaaaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4545 - RNA, 1623 nt, Artificial Sequence
  capsid_protein_VP1__Norovirus__AGE89601
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucagacaaaugauucuaccauuaaauugauagcaaugcuguauacaccacuuagggccaauaaugcuggggaagaugucuuuacagucucuugucgaguccucacuaggccguccccugauuuugauuuuauauuuuuggugccacccacaguugagucaagaaccaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacccaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccaggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4546 - RNA, 1623 nt, Artificial Sequence
  capsid_protein_VP1__Norovirus__AGE89604
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguuuacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccauauaauaguagauguuaggcaauuggaaccuguguugauccccuuacccgauguuaggaauaauuucuaccauuauaaucagacaaaugauucuaccauuaaauugauagcaaugcuauauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaacuacacaaugaacuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaaugugcaccuagccccugcuguagcccccacuuuuccgggugaacaacuucucuucuucagguccacuaugcccggaugcagcggguaucccaacauggauuuggauugccuacucccccaggagugggugcagcacuucuaccaagaggcagcuccagcacaaucugauguggcucuguugagauuugugaauccagacacggguaggguccuguuugagugcaaacuucauaaaucaggcuaugucacaguggcucacaccggucagcaugauuuggucauccccccuaauggcuauuuuagguuugauuccuggguuaaucaguucuacacgcuugcccccaugggaaauggaacggggcguaggcgugccuuauaa

SEQ ID NO: 4547 - RNA, 1623 nt, Artificial Sequence; identical to SEQ ID NO: 4546
  capsid_protein_VP1__Norovirus__AGE89607

SEQ ID NO: 4548 - RNA, 1623 nt, Artificial Sequence
  capsid_protein_VP1__Norovirus__AGE89610
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuugugcaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaacgcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugcuuuuguuguccaaccacaaaauggcaggugcacgacugauggcgugcucuuaggcaccacccaacugucucccgucaacaucugcaccuucagaggggaugucacccacauugcagguucucguaauuauacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccaguaggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauucgugaauccagacacggguaggguccuguuugagugcaaacuucacaaaucaggcuaugucacaguggcucacaccggucagcaugauuuggucaucccccccaauggcuauuuuagguuugauuccuggguuaaucaguucuauacgcuugcccccaugggaaacggaacggggcguaggcgcgccuuauaa

SEQ ID NO: 4549 - RNA, 1623 nt, Artificial Sequence
  capsid_protein_VP1__Norovirus__AGE89613
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguuuacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccauauaauaguagauguuaggcaauuggaaccuguguugauccccuuaccugauguuaggaauaauuucuaccauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccagcugucuccugucaacaucugcaccuucagaggggaugucacccacauugcagguucucgugacuacacaaugaacuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaaugugcaccuagccccugcuguagcccccacuuuuccgggugaacaacuucucuucuucagguccacuaugcccggaugcagcggguaucccaacauggauuuggauugccuacucccccaggagugggugcagcacuucuaccaagaggcagcuccagcacaaucugauguggcucuguugagauuugugaauccagacacagguaggguccuguuugagugcaaacuucauaaaucaggcuaugucacaguggcucacaccggucagcaugauuuggucauccccccuaauggcuauuuuagguuugauuccuggguuaaucaguucuacacgcuugcccccaugggaaauggaacggggcguaggcgugccuuauaa

SEQ ID NO: 4550 - RNA, 1623 nt, Artificial Sequence
  capsid_protein_VP1__Norovirus__AGE89616
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuuuccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggaaaugaccaauucaagguuccccauuccuuuggagaaguuguucacgggccccaguaaugccuuuguuguucaaccacaaaacggcaggugcacgaccgauggcgugcuccuagguacuacccaacugucucccgucaacaucugcaccuucagaggggacgucacccauauuccaggcagucguaacuacacaaugaauuuggccucccaaaauuggaacaguuacgacccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuauucagguagagauguucauaaugugcaccuggccccugcuguagcccccacuuucccgggcgagcagcuccucuucuucagaucuacuaugcccggaugcagcggguaccccaacauggacuuggacugucugcucccccaggaaugggugcaauauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 4551 - RNA, 1623 nt, Artificial Sequence
  capsid_protein_VP1__Norovirus__AGE89622
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaacaaugccggggacgaugucuucacaguuucuugucgaguucucacgagaccaucccccgauuuugauuuuauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggacgucacccauauuccaggcagucguaacuacacaaugaauuuggccucccaaaauuggaacaguuacgauccaacagaagaaaucccagccccccugggaacuccagauuucguggggaagauucagggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggacuuggacugucugcucccccaggaaugggugcaauauuucuaccaggaggcagccccagcacaaucugauguggcucugcuaagauuugugaauccggacacagguaggguuuuguuugaguguaagcuucauaaaucaggcuauguuacaguggcacacacuggccaacaugauuuaguuaucccccccaaugguuauuuuagauuugauuccugggucaaccaguucuacacacuugcccccaugggaaaugggacggggcguagacgugcauuauaa

SEQ ID NO: 4552 - RNA, 1623 nt, Artificial Sequence
  capsid_protein_VP1__Norovirus__AGE89625
augaagauggcgucgagugacgccaacccaucugauggguccacagccaaccuugucccagaggucaauaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggacgucacccauauuccaggcagccguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaauuaaccaaaacacaaaguucaccccagucgguguuauccaggaugguaguaccaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggacuuggacugucugcucccccaggaaugggugcaauauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 4553 - RNA, 1623 nt, Artificial Sequence
  capsid_protein_VP1__Norovirus__AGE89628
augaagauggcgucgagugacgccaacccaucugauggguccacagccaaccuugucccagaggucaauaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaauccuuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggacgucacccauauuucaggcagucguaacuacacaaugaauuuggccucccaaaauuggaacaguuacgauccaacagaagaaaucccagccccucuaggaacuccagauuucguggggaagauucaaggugugcucacccaaaccacaaggacagauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggauggugguaccacccaccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggacuuggacugucugcucccccaggaaugggugcaauauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 4554 - RNA, 1623 nt, Artificial Sequence; identical to SEQ ID NO: 4473
  capsid_protein_VP1__Norovirus__AGE89631

SEQ ID NO: 4555 - RNA, 1623 nt, Artificial Sequence
  capsid_protein_VP1__Norovirus__AGE89634
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucagacaaaugauucuaccauuaaauugauagcaaugcuguauacaccacuuagggccaauaaugcuggggaagaugucuuuacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguagcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4556 - RNA, 1623 nt, Artificial Sequence
  capsid_protein_VP1__Norovirus__AGE89637
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacaucgcagguucucguaacuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4557 - RNA, 1623 nt, Artificial Sequence
  capsid_protein_VP1__Norovirus__AGE89640
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucccauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucagaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguggcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4558 - RNA, 1623 nt, Artificial Sequence
  capsid_protein_VP1__Norovirus__AGE89643
augaagauggcgucgaaugacgccaacccaucugauggguccgcagccaaccucgucccagaggucagcaaugagguuauggcuuuggaacccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauucccuuaccugauguuaggaauaauuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcagaugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggaaccacccaccgaaaugaaccccaacaauggaugcucccaaguuauucagguagagauguucauaauguacaccuagccccugcuguagcccccacuuuuccgggugaacaacuucuuuucuucagguccaccaugcccggaugcagcggguaucccaacauggauuuggauugccuacucccccaggagugggugcagcacuucuaccaagaggcagcuccagcacaaucugauguggcucuacugagauuugugaauccagacacggguaggguccuguuugagugcaaacuucauaaaucagguuaugucacaguggcucacaccggucagcaugauuuggucaucccccccaauggcuauuuuagguuugauuccuggguuaaucaauucuacacacuugcccccaugggaaacggaacggggcguaggcgcgcuuuauga

SEQ ID NO: 4559 - RNA, 1623 nt, Artificial Sequence
  capsid_protein_VP1__Norovirus__AGE89646
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccgucgaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4560 - RNA, 1623 nt, Artificial Sequence
  capsid_protein_VP1__Norovirus__AGE89649
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaagucacuauguucccccacauaauaguagauguuaggcaauuggaaccuguguugauccccuuaccugauguuaggaauaacuucuaucauuauaaucagacaaaugauccuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccacaaagcuacaguuuacacugggagugcccccuuuacuccaaagcugggcaguguucaauucaguacugacacagaaaaugauuuugaaacucaccaaaacacaaaauucaccccagucgguguuauccaggaugguggcaccacccaccgaaaugaaccccaacaaugggugcucccaagcuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4561 - RNA, 1623 nt, Artificial Sequence
  capsid_protein_VP1__Norovirus__AGE89652
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaccccuaccuuucccauuuggccagaauguacaaugguuaugcaggugguuuugaagugcagguaguccucgcggggaacgcguucaccgccggaaaaauuauauuugcagcagucccaccaaauuucccaacugaaggcuugagccccagccaggucaccauguucccccacaugauaguagauguuaggcaauuggaaccuguguugaucccccuacccgauguuaggaauaauuucuaucacuauaaccaaucaaaugaccccaccaucaaauugauagcaauguuguauacaccacuuagggccaauaaugcuggggacgaugucuucacagucucuugucggguucucacgaggccaucccccgauuuugauuucauauuuuuaguaccacccacaguugagucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgacugauggcgugcuccuagguaccacccaacugucuccugucaacaucugcacuuucagaggggaugucacccauauuacagguagucauaacuacacaaugaauuuggcuacucaaaauuggaacaguuaugacccaacagaagaaaucccagccccucugggaacuccagauuucguggggaagauucaaggugugcucacccaaaccacaagggcagauggcucgacccgcggccacaaagccacaguguacacugggagcgccgauuuugcuccaaaacuggguagaguucaauuugccacugacacaaacaaugaucuuggugccaaccaaaacacaaaguucaccccagucggugucauccaggaugguggcacugcccaccgaaaugaaccccaacaaugggugcucccaaguuacucaggcagaaauagucauaaugugcaccuggcccccgcuguagcccccacuuuuccgggugagcaacuucucuucuuuagauccacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacuguggcucacacuggccaacaugauuugguuaucccccccaaugguuauuuuagauuugauuccugggucaaccaguucuacacacuugcccccaugggaaauggaacggggcguagacgugcguuauaa

SEQ ID NO: 4562 - RNA, 1623 nt, Artificial Sequence
  capsid_protein_VP1__Norovirus__AGE89655
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguuuacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauuaauagcaaugcuguauacaccacuuagggccaauaacgcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugcuuuuguuguccaaccacaaaauggcaggugcacgacugauggcgugcucuuaggcaccacccaacugucucccgucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaccccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4563 - RNA, 1623 nt, Artificial Sequence
  capsid_protein_VP1__Norovirus__AGE89658
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaccccuaccuaucccauuuggccagaauguauaaugguuaugcaggugguuuugaagugcaggugauccucgcggggaacgcguucaccgccggaaaaauaauauuugcagcagucccaccaaauuuuccaacugaaggccugagucccagccaggucacuauguucccccacauaauaguagauguuaggcaauuggaacccguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaaucuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuacuuuagguuugauuccuggguuaaucaguucuacacgcuugcccccaugggaaacggaacggggcguaggcgcgccuuauaa

SEQ ID NO: 4564 - RNA, 1623 nt, Artificial Sequence; identical to SEQ ID NO: 4498
  capsid_protein_VP1__Norovirus__AGE89661

SEQ ID NO: 4565 - RNA, 1623 nt, Artificial Sequence
  capsid_protein_VP1__Norovirus__AGE89664
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaccauuauaaucagacaaaugauucuaccauuaaauugauagcaaugcuguauacaccacuuagggccaauaacgcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugcuuuuguuguccaaccacaaaauggcaggugcacgacugauggcgugcucuuaggcaccacccaacugucucccgucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaaguugggcaguguucaauucaguacugacacagaagaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4566 - RNA, 1623 nt, Artificial Sequence; identical to SEQ ID NO: 4498
  capsid_protein_VP1__Norovirus__AGE89667

SEQ ID NO: 4567 - RNA, 1623 nt, Artificial Sequence
  capsid_protein_VP1__Norovirus__AGE89673
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaaucauauuugcagcagucccaccaaauuuuccaacugaaggccugagucccagccaggucaccauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaacgcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugcuuuuguuguccaaccacaaaacggcaggugcacgacugauggcgugcucuuaggcaccacccaacugucucccgucaacaucugcaccuucagaggggaugucacccacauugcagguucucguaauuacacaaugaauuuggcaucucuaaauuggaacaauuacgacccaacagaagaaauuccagccccucugggaacuccagauuuugugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4568 - RNA, 1623 nt, Artificial Sequence
  capsid_protein_VP1__Norovirus__AGE99603
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaguaacuuuguacaagccccugguggagaguucacaguauccccuagaaacgcuccaggugaaauacuuuggagcgcgcccuuaggcccugaucugaaucccuaccuaucucauuuggccagaauguauaaugguuaugcaggugguuuugaagugcagaugauccucgcggggaacgcguucaccgcgggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaccagucaaaugauccuaccauuaaauugauagcaaugcuguauacaccacucagggccaauaaugccggggaugaugucuucacagucucuugucgaguccucacgaggccauccccugauuuugacuucauauuucuggugccaccuacaguugagucaagaacuaaaccauuuacugucccagucuugacuguugaagaaaugaccaauucaagauuccccauuccuuuggagaaauuguucacgggucccagcagugccuuuguuguucaaccacaaaauggcagaugcacaacugauggcgugcucuuaggcaccacccagcugucuccugucaacaucugcaccuucagaggggaugucacccacauugcggguucccguaauuacacaaugaauuuggccucucuaaauuggaacaauuaugacccaacagaagagauuccagccccucugggaacuccagauuucgugggaaagauccaaggugugcucacucaaaccacaaagggagauggcucgacccggggccauaaagcuacaguuuacacugggagugccgacuucacuccaaagcugggcaguguucaauuugguacugauacagauaaugacuuugaaacucaccaaaacacaagauuuaccccagucggugucauccaggauggugcgaccacccaccgaaaugaaccccaacaaugggugcucccaaguuauucaggaagaaauguccauaauguacaccuagccccugcuguagcccccaauuuuccgggcgaacaacuucuuuucuucagguccacuaugcccggaugcagcggguaucccaacauggauuuggauugccuacucccccaggagugggugcaacacuucuaccaagaggcagcuccagcacaauccgauguggcucuauugagauuugugaauccagacacggguagggucuuguuugagugcaaacuccauaaaucaggcuaugucacaguggcucauaccggccaacaugauuuggucaucccccccaaugguuauuuuagguuugauuccuggguuaaucaguucuacacacuugcccccaugggaaauggaacggggcgcagacgugcuuuauaa

SEQ ID NO: 4569 - RNA, 1623 nt, Artificial Sequence
  capsid_protein_VP1__Norovirus__AGI17592
augaugauggcgucgaaugacgcugcuccaucuaaugauggugcuacgggccucgucccagagaucaaccacgagacccuuccucuggaaccgguggcgggugcagccauugccgcgccugucacuggccaaaauaauauaauugaucccuggauuagaacaaauuuuguacaagcacccaauggagaguucacugucucaccuagaaacucuccuggagaaauucuuuuaaauuuggaauuggguccugauuuaaacccauauuuggcacacuuaucuagaauguacaauggguaugcugguggcguggaaguucaaguccuccuagcagggaacgcguucacugcagggaaaauucucuucgcugccgugccaccaaauuucccaguugaauucuugaguccugcacaaaucaccauguugccacacuuaauaguugauguuagaacccuugaaccuaucaugauaccacucccugauguuaggaacaccuucuuccauuacaauaaccaaccugccaaccgcaugcgacugguagccauguuguauaccccuuugagaucuaaugguuccggcgaugaugucuucacuguuucauguagagugcugacuaggcccaccccagauuuugaguucacauauuugguccccccuucaguagagucuaagacuaaacccuuuucucuaccuauauuaaccauuucugaauuaaccaauucaagauuuccugcacccauagauucauuguacacagcccaaaacaacaaucucaauguccaaugucaaaauggucggugcacacuggauggugaacugcagggaaccacucaguugcugccuucaggcauaugugcuuucaggggcaaauuaacagcagauguacaccaaagccacgaugacagauggcacaugcagcugacaaaucuuaaugggacccccuuugauccaacagaggaugugccagcuccguuaggcaccccagauuucacaggccuccucuucggaguggcgagucagaggaauguuguauccaauccaaacaccaccagggcacacgaggcugugaucuccacaaccaguucacaguuugugccaaaauuaggaucaaucaacuuugguaguacaagugaugauuuccaguuacaacaacccaccaaauuuacaccaguuggaauuaagguugagaguggacaugauuuugaccaaugggcccugcccagauauucaggucauuuaacccuuaauaugaaucuugccccgccuguugcuccaaauuucccuggugaacagcuguuguucuuuagaucaaauguuccuugugcugguggcgucagugauggugucaucgacuguuuguugccucaggaguggauacaguacuucuaccaggagucugcucccucccagucugauguggcccuuaucagguacgucaauccugacacgggucgcacacucuucgaggcgaaacuccacagaacaggcuacaucacuguugcucauucaggugauuauccccuuguuguccccucuaauggauacuucagauuugauucuugggugaaccaguuuuacucacucgcccccaugggaacuggaaacgggcgcagacgggugcaguaa

SEQ ID NO: 4570 - RNA, 1650 nt, Artificial Sequence
  capsid_protein_VP1__Norovirus__AGI17594
augaagauggcgucgaaugacgccgcuccaucuaacgauggugccgccggccucgucccagagaucaacagugaggcaauggcgcuagaaccaguggcgggugcagcgauagcagcaccccuuacuggucagcaaaauauaauugaucccuggauuaugaauaauuuugugcaagcaccugguggugaguuuacaauauccccuaggaauggcccuggugaagugcuucuuaauuuggaauuaggcccagaaauaaaccccuauuuggcccaucuugcuagaauguauaaugguuaugcagguggauuugaggugcagguaguccuagcugggaaugcguucacagcaggaaagauaaucuuugcagccauaccccccaacuuuccaauugacaaucugagcgcagcacaggucacaaugugcccgcauguaauuguggaugucaggcaacuggaaccggucaaccucccgaugccugauguucgcaacuccuucuuccauuauaaucaagggacugauucgagauugcgcuuaauugcuaugcuuuacacaccucuuagggcaaauaauucuggugaugauguuuucacugugucuugcagggugcugaccaggccuagcccugacuuuucauuuaauuuucuugugccaccuacuguggaaucaaagacaaaacccuuuacucuuccuauucugacuaucucugaaaugucuaauucuagguuuccagugccgauugauucucuacauaccagcccaacugauaacauuguuguccagugccaaaacgggcgugucacucuugauggugagcugaugggcaccacccaacucuuaccgagucaaaucugcgccuucaggggcgugcucacucaacgaacaagcagggccagugaucaggccgacacagcaguaacccccagggcauucgaucaccguuggcacauacaauuggauaaucuaaauggaacccauuaugacccuucagaagacauaccaggcccucuagggauaccagauuuccgggguagagucuauggcguggccagccagagaaacucugauggaucaaccagagcacaugaagcaaagauagauacaacaucuagucgcuucaccccaaaauuaggcucauuagaaauauccacugaaucugaugauuuugaugaaaacaaaccaaccagauucaccccaguuggcauugggguugacaaugagagagaauuucaacaaugguccuuacccgacuauucuggucaauucacccacaacaugcaccuggccccagcuguugcuccuaacuucccuggugagcagcuccuuuucuuccgcucgcauuuaccaucuucugguggguggguugacgggacucuagacugucugcucccccaagaauggauacaacacuucuaucaagaaucggcucccucccaaacacagguggcccuggucagguaugucaacccugacacugguagagugcuauuugaggccaaacugcacaaaucagguuucaugacuauagcuaggaguggugauucuccaauaacugucccuccaaauggguauuucagauuugaaucuugggugaaccccuuuuacacacuugcccccaugggaacugggaaugggcguagaagaauucaauaa

SEQ ID NO: 4571 - RNA, 1623 nt, Artificial Sequence
  capsid_protein_VP1__Norovirus__AGK36311
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucccauuuggccagaauguauaaugguuaugcaggugguuuugaagugcgggugauccucgcggggaacgcguucaccgccggaaaaauuauauuugcagcagucccaccaaauuuuccaacugaaggccugagucccagccaggucacuauguucccccacauaauaguagauguuaggcaacuggaaccuguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcagugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacccaaaccacaaaaggagauggcucgacccguggccauaaagcuacaguuuacacugggagugcccccuuuacuccaaagcugggcaguguucaauucaguacugacacagaaaaugauuuugaaauucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuucccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucauuccccccaauggcuauuuuagguuugauuccuggguuaaucaguucuacacgcuugcccccaugggaaacggaacggggcguaggcgcgccuuauaa

SEQ ID NO: 4572 - RNA, 1623 nt, Artificial Sequence
  capsid_protein_VP1__Norovirus__AGK36314
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguguccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcaguuccaccaaauuucccaacugaagguuugagccccagccaggucacuauguucccccacauaauaguagauguuaggcaauuggaaccuguguugauucccuuacccgauguuaggaauaauuucuaccauuauaaucaaucaaacgaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggacgucacccauauuccaggcagucguaacuacacaaugaauuuggccucccaaaauuggaacaguuacgacccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggacuuggacugucugcucccccaggaaugggugcaauauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 4573 - RNA, 1593 nt, Artificial Sequence
  capsid_protein_VP1__Norovirus__AGM33208
augaugauggcgucuaaggacgcuacaucaagcguggauggcgcuaguggcgcuggucaguugguaccggagguuaaugcuucugacccucuugcaauggauccuguagcagguucuucgacagcagucgcgacugcuggacaaguuaauccuauugaucccuggauaauuaauaauuuugugcaagccccccaaggugaauuuacuauuuccccaaauaauacccccggugauguuuuguuugauuugaguuuggguccccaucuuaauccuuucuugcuccaucuaucacaaauguauaaugguuggguugguaacaugagagucaggauuaugcuagcugguaaugccuuuacugcggggaagauaauaguuuccugcauacccccugguuuugguucacauaaucuuacuauagcacaagcaacucucuuuccacaugugauugcugauguuaggacucuagaccccauugaggugccuuuggaagauguuaggaauguucucuuucauaauaaugauagaaaucaacaaaccaugcgccuugugugcaugcuguacaccccccuccgcacugguggugguacuggugauucuuuuguaguugcagggcgaguuaugacuugccccaguccugauuuuaauuucuuguuuuuagucccuccuacgguggagcagaaaaccaggcccuucacacucccaaaucugccauugaguucucugucuaacucacgugccccucucccaaucaguaguaugggcauuuccccagacaauguccagagugugcaguuccaaaauggucgguguacucuggauggccgccugguuggcaccaccccaguuucauugucacauguugccaagauaagagggaccuccaauggcacuguaaucaaccuuacugaauuggauggcacacccuuucacccuuuugagggcccugcccccauuggguuuccagaccucggugguugugauuggcauaucaauaugacacaguuuggccauucuagccagacccaguaugauguagacaccaccccugacacuuuugucccccaucuugguucaauucaggcaaauggcauuggcagugguaauuauguugguguucuuagcuggauuucccccccaucacacccgucuggcucccaaguugaccuuuggaagauccccaauuaugggucaaguauuacggaggcaacacaucuagccccuucuguauaccccccugguuucggagagguauuggucuuuuucaugucaaaaaugccagguccuggugcuuauaauuugcccugucuauuaccacaagaguacauuucacaucuugcuagugaacaagccccuacuguaggugaggcugcccugcuccacuauguugacccugauaccggucggaaucuuggggaauucaaagcauacccugaugguuuccucacuuguguccccaauggggcuagcucggguccacaacagcugccgaucaauggggucuuugucuuuguuucauggguguccagauuuuaucaauuaaagccugugggaacugccagcucggcaagagguaggcuuggucugcgccgauaa

SEQ ID NO: 4574 - RNA, 1593 nt, Artificial Sequence
  capsid_protein_VP1__Norovirus__AGM33214
augaugauggcgucuaaggacgcuacaucaagcguggauggcgcuaguggcgcuggucaguugguaccggagguuaaugcuucugacccucuugcaauggauccuguagcagguucuucgacagcagucgcgacugcuggacaaguuaauccuauugaucccuggauaauuaauaauuuugugcaagccccccaaggugaauuuacuauuuccccaaauaauacccccggugauguuuuguuugauuugaguuuggguccccaucuuaauccuuucuugcuccaucuaucacaaauguauaaugguuggguugguaacaugagagucaggauuaugcuagcugguaaugccuuuacugcggggaagauaauaguuuccugcauacccccugguuuugguucacauaaucuuacuauagcacaagcaacucucuuuccacaugugauugcugauguuaggacucuagaccccauugaggugccuuuggaagauguuaggaauguucucuuucauaauaaugauagaaaucaacaaaccaugcgccuugugugcaugcuguacaccccccuccgcacugguggugguacuggugauucuuuuguaguugcagggcgaguuaugacuugccccaguccugauuuuaauuucuuguuuuuagucccuccuacgguggagcagaaaaccaggcccuucacacucccaaaucugccauugaguucucugucuaacucacgugccccucucccaaucaguaguaugggcauuuccccagauaauguccagagugugcaguuccaaaauggucgguguacucuggauggccgccugguuggcaccaccccaguuucauugucacauguugccaagauaagagggaccucuaauggcacuguaaucaaccuuacugaauuggauggcacacccuuucacccuuuugagggcccugcccccauuggguucccagaccucggugguugugauuggcauaucaauaugacacaguuuggccauucuagccagacccaguaugauguaaacaccaccccugacacuuuugucccccaucuugguucaauucaggcaaauggcauuggcagugguaauuauguugguguucuuagcuggauuucccccccaucacacccgucuggcucccaaguugaccuuuggaagauccccaauuaugggucaaguauuacggaggcaacacaucuagccccuucuguauaccccccugguuucggagagguauuggucuuuuucaugucaaaaaugccagguccuggugcuuauaauuugcccugucuauuaccacaagaguacauuucacaucuugcuagugaacaagccccuacuguaggugaggcugcccugcuccacuauguugacccugauaccggucggaaucuuggggaauucaaagcauacccugaugguuuccucacuuguguccccaauggggcuagcucggguccacaacagcugccgaucaauggggucuuugucuuuguuucauggguguccagauuuuaucaauuaaagccugugggaacugccagcucggcaagagguaggcuuggucugcgccgauaa

SEQ ID NO: 4575 - RNA, 1593 nt, Artificial Sequence; identical to SEQ ID NO: 4573
  capsid_protein_VP1__Norovirus__AGM33217

SEQ ID NO: 4576 - RNA, 1593 nt, Artificial Sequence
  capsid_protein_VP1__Norovirus__AGM33220
augaugauggcgucuaaggacgcuacaucaagcguggauggcgcuaguggcgcuggucaguugguaccggagguuaaugcuucugacccucuugcaauggauccuguagcagguucuucgacagcagucgcgacugcuggacaaguuaauccuauugaucccuggauaauuaauaauuuugugcaagccccccaaggugaauuuacuauuuccccaaauaauacccccggugauguuuuguuugauuugaguuuggguccccaucuuaauccuuucuugcuccaucuaucacaaauguauaaugguuggguugguaacaugagagucaggauuaugcuagcugguaaugccuuuacugcggggaagauaauaguuuccugcauacccccugguuuugguucacauaaucuuacuauagcacaagcaacucucuuuccacaugugauugcugauguuaggacucuagaccccauugaggugccuuuggaagauguuaggaauguucucuuucauaauaaugauagaaaucaacaaaccaugcgccuugugugcaugcuguacaccccccuccgcacugguggugguacuggugauucuuuuguaguugcagggcgaguuaugacuugccccaguccugauuuuaauuucuuguuuuuagucccuccuacgguggagcagaaaaccaggcccuucacacucccaaaucugccauugaguucucugucuaacucacgugccccucucccaaucaguaguaugggcauuuccccagacaauguccagagugugcaguuccaaaauggucgguguacucuggauggccgccugguuggcaccaccccaguuucauugucacauguugccaagauaagagggaccuccaauggcacuguaaucaaccuuacugaauuggauggcacacccuuucacccuuuugagggcccugcccccauuggguuuccagaccucggugguugugauuggcauaucaauaugacacaguuuggccauucuagccagacccaguaugauguagacaccaccccugacacuuuugucccccaucuugguucaauucaggcaaauggcguuggcagugguaauuauguugguguucuuagcuggauuucccccccaucacacccgucuggcucccaaguugaccuuuggaagauccccaauuaugggucaaguauuacggaggcaacacaucuagccccuucuguauaccccccugguuucggagagguauuggucuuuuucaugucaaaaaugccagguccuggugcuuauaauuugcccugucuauuaccacaagaguacauuucacaucuugcuagugaacaagccccuacuguaggugaggcugcccugcuccacuauguugacccugauaccggucggaaucuuggggaauucaaagcauacccugaugguuuccucacuuguguccccaauggggcuagcucggguccacaacagcugccgaucaauggggucuuugucuuuguuucauggguguccagauuuuaucaauuaaagccugugggaacugccagcucggcaagagguaggcuuggucugcgccgauaa

SEQ ID NO: 4577 - RNA, 1593 nt, Artificial Sequence
  capsid_protein_VP1__Norovirus__AGM33226
augaugauggcgucuaaggacgcuacaucaagcguggauggcgcuaguggcgcuggucaguugguaccggagguuaaugcuucugacccucuugcaauggauccuguagcagguucuucgacagcagucgcgacugcuggacaaguuaauccuauugaucccuggauaauuaauaauuuugugcaagccccccaaggugaauuuacuauuuccccaaauaauacccccggugauguuuuguuugauuugaguuuggguccccaucuuaauccuuucuugcuccaucuaucacaaauguauaaugguuggguugguaacaugagagucaggauuaugcuagcugguaaugccuuuacugcggggaagauaauaguuuccugcauacccccugguuuugguucacauaaucuuacuauagcacaagcaacucucuuuccacaugugauugcugauguuaggacucuagaccccauugaggugccuuuggaagauguuaggaauguucucuuucauaauaaugauagaaaucaacaaaccaugcgccuugugugcaugcuguacaccccccuccgcacugguggugguacuggugauucuuuuguaguugcagggcgaguuaugacuugccccaguccugauuuuaauuucuuguuuuuagucccuccuacgguggagcagaaaaccaggcccuucacacucccaaaucugccauugaguucucugucuaacucacgugccccucucccaaucaguaguaugggcauuuccccagacaauguccagagugugcaguuccaaaauggucgguguacucuggauggccgccugguuggcaccaccccaguuucauugucacauguugccaagauaagagggaccuccaauggcacuguaaucaaccuuacugaauuggauggcacacccuuucacccuuuugagggcccugcccccauuggguuuccagaccucggugguugugauuggcauaucaauaugacacaguuuggccauucuagccagacccaguaugauguagacaccaccccugacauuuuugucccccaucuugguucaauucaggcaaauggcauuggcagugguaauuauguugguguucuuagcuggauuucccccccaucacacccgucuggcucccaaguugaccuuuggaagauccccaauuaugggucaaguauuacggaggcaacacaucuagccccuucuguauaccccccugguuucggagagguauuggucuuuuucaugucaaaaaugccagguccuggugcuuauaauuugcccugucuauuaccacaagaguacauuucacaucuugcuagugaacaagccccuacuguaggugaggcugcccugcuccacuauguugacccugauaccggucggaaucuuggggaauucaaagcauacccugaugguuuccucacuuguguccccaauggggcuagcucggguccacaacagcugccgaucaauggggucuuugucuuuguuucauggguguccagauuuuaucaauuaaagccugugggaacugccagcucggcaagagguaggcuuggucugcgccgauaa

SEQ ID NO: 4578 - RNA, 1593 nt, Artificial Sequence
  capsid_protein_VP1__Norovirus__AGM33229
augaugauggcgucuaaggacgcuacaucaagcguggauggcgcuaguggcgcuggucaguugguaccggagguuaaugcuucugacccucuugcaauggauccuguagcagguucuucgacagcagucgcgacugcuggacaaguuaauccuauugaucccuggauaauuaauaauuuugugcaagccccccaaggugaauuuacuauuuccccaaauaauacccccggugauguuuuguuugauuugaguuuggguccccaucuuaauccuuucuugcuccaucuaucacaaauguauaaugguuggguugguaacaugagagucaggauuaugcuagcugguaaugccuuuacugcggggaagauaauaguuuccugcauacccccugguuuugguucacauaaucuuacuauagcacaagcaacucucuuuccacaugugauugcugauguuaggacucuagaccccauugaggugccuuuggaagauguuaggaauguucucuuucauaauaaugauagaaaucaacaaaccaugcgccuugugugcaugcuguacaccccccuccgcacugguggugguacuggugauucuuuuguaguugcagggcgaguuaugacuugccccaguccugauuuuaauuucuuguuuuuagucccuccuacgguggagcagaaaaccaggcccuucacacucccaaaucugccauugaguucucugucuaacucacgugccccucucccaaucaguaguaugggcauuuccccagauaauguccagagugugcaguuccaaaauggucgguguacucuggauggccgccugguuggcaccaccccaguuucauugucacauguugccaagauaagagggaccucuaauggcacuguaaucaaccuuacugaauuggauggcacacccuuucacccuuuugagggcccugcccccauuggguucccagaccucggugguugugauuggcauaucaauaugacacaguuuggccauucuagccagacccaguaugauguagacaccaccccugucacuuuugucccccaucuugguucaauucaggcaaauggcauuggcagugguaauuauguugguguucuuagcuggauuucccccccaucacacccgucuggcucccaaguugaccuuuggaagauccccaauuaugggucaaguauuacggaggcaacacaucuagccccuucuguauaccccccugguuucggagagguauuggucuuuuucaugucaaaaaugccagguccuggugcuuauaauuugcccugucuauuaccacaagaguacauuucacaucuugcuagugaacaagccccuacuguaggugaggcugcccugcuccacuauguugacccugauaccggucggaaucuuggggaauucaaagcauacccugaugguuuccucacuuguguccccaauggggcuagcucggguccacaacagcugccgaucaauggggucuuugucuuuguuucauggguguccagauuuuaucaauuaaagccugugggaacugccagcucggcaagagguaggcuuggucugcgccgauaa

SEQ ID NO: 4579 - RNA, 1593 nt, Artificial Sequence
  capsid_protein_VP1__Norovirus__AGM33232
augaugauggcgucuaaggacgcuacaucaagcguggauggcgcuaguggcgcuggucaguugguaccggagguuaaugcuucugacccucuugcaauggauccuguagcagguucuucgacagcagucgcgacugcuggacaaguuaauccuauugaucccuggauaauuaauaauuuugugcaagccccccaaggugaauuuacuauuuccccaaauaauacccccggugauguuuuguuugauuugaguuuggguccccaucuuaauccuuucuugcuccaucuaucacaaauguauaaugguuggguugguaacaugagagucaggauuaugcuagcugguaaugccuuuacugcggggaagauaauaguuuccugcauacccccugguuuugguucacauaaucuuacuauagcacaagcaacucucuuuccacaugugauugcugauguuaggacucuagaccccauugaggugccuuuggaagauguuaggaauguucucuuucauaauaaugauagaaaucaacaaaccaugcgccuugugugcaugcuguacaccccccuccgcacugguggugguacuggugauucuuuuguaguugcagggcgaguuaugacuugccccaguccugauuuuaauuucuuguuucuagucccuccuacgguggagcagaaaaccaggcccuucacacucccaaaucugccauugaguucucugucuaacucacgugccccucucccaaucaguaguaugggcauuuccccagauaauguccagagugugcaguuccaaaauggucgguguacucuggauggccgccugguuggcaccaccccaguuucauugucacauguugccaagauaagagggaccucuaauggcacuguaaucaaccuuacugaauuggauggcacacccuuucacccuuuugagggcccugcccccauuggguucccagaccucggugguugugauuggcauaucaauaugacacaguuuggccauucuagccagacccaguaugauguagacaccaccccugacacuuuugucccccaucuugguucaauucaggcaaauggcauuggcagugguaauuauguugguguucuuagcuggauuucccccccaucacgcccgucuggcucccaaguugaccuuuggaagauccccaauuaugggucaaguauuacggaggcaacacaucuagccccuucuguauaccccccugguuucggagagguauuggucuuuuucaugucaaaaaugccagguccuggugcuuauaauuugcccugucuauuaccacaagaguacauuucacaucuugcuagugaacaagccccuacuguaggugaggcugcccugcuccacuauguugacccugauaccggucggaaucuuggggaauucaaagcauacccugaugguuuccucacuuguguccccaauggggcuagcucggguccacaacagcugccgaucaauggggucuuugucuuuguuucauggguguccagauuuuaucaauuaaagccugugggaacugccagcucggcaagagguaggcuuggucugcgccgauaa

SEQ ID NO: 4580 - RNA, 1593 nt, Artificial Sequence
  capsid_protein_VP1__Norovirus__AGM33235
augaugauggcgucuaaggacgcuacaucaagcguggauggcgcuaguggcgcuggucaguugguaccggagguuaaugcuucugacccucuugcaauggauccuguagcagguucuucgacagcagucgcgacugcuggacaaguuaauccuauugaucccuggauaauuaauaauuuugugcaagccccccaaggugaauuuacuauuuccccaaauaauacccccggugauguuuuguuugauuugaguuuggguccccaucuuaauccuuucuugcuccaucuaucacaaauguauaaugguuggguugguaacaugagagucaggauuaugcuagcugguaaugccuuuacugcggggaagauaauaguuuccugcauacccccugguuuugguucacauaaucuuacuauagcacaagcaacucucuuuccacaugugauugcugauguuaggacucuagaccccauugaggugccuuuggaagauguuaggaauguucucuuucauaauaaugauagaaaucaacaaaccaugcgccuugugugcaugcuguacaccccccuccgcacugguggugguacuggugauucuuuuguaguugcagggcgaguuaugacuugccccaguccugauuuuaauuucuuguuuuuagucccuccuacgguggagcagaaaaccaggcccuucacacucccaaaucugccauugaguucucugucuaacucacgugccccucucccaaucaguaguaugggcauuuccccagacaauguccagagugugcaguuccaaaauggucgguguacucuggauggccgccugguuggcaccaccccaguuucauugucacauguugccaagauaagagggaccuccaauggcacuguaaucaaccuuacugaauuggauggcacacccuuucacccuuuugagggcccugcccccauuggguuuccagaccucggugguugugauuggcauaucaauaugacacaguuuggccauucuagccagacccaguaugauguagacaccaccccugacacuuuugucccccaucuugguucaauucaggcaaauggcauuggcagugguaauuauguugguguucuuagcuggauuucccccccaucacgcccgucuggcucccaaguugaccuuuggaagauccccaauuaugggucaaguauuacggaggcaacacaucuagccccuucuguauaccccccugguuucggagagguauuggucuuuuucaugucaaaaaugccagguccuggugcuuauaauuugcccugucuauuaccacaagaguacauuucacaucuugcuagugaacaagccccuacuguaggugaggcugcccugcuccacuauguugacccugauaccggucggaaucuuggggaauucaaagcauacccugaugguuuccucacuuguguccccaauggggcuagcucggguccacaacagcugccgaucaauggggucuuugucuuuguuucauggguguccagauuuuaucaauuaaagccugugggaacugccagcucggcaagagguaggcuuggucugcgccgauaa

SEQ ID NO: 4581 - RNA, 1593 nt, Artificial Sequence
  capsid_protein_VP1__Norovirus__AGM33238
augaugauggcgucuaaggacgcuacaucaagcguggauggcgcuaguggcgcuggucaguugguaccggagguuaaugcuucugacccucuugcaauggauccuguagcagguucuucgacagcagucgcgacuacuggacaaguuaauccuauugaucccuggauaauuaauaauuuugugcaagccccccaaggugaauuuacuauuuccccaaauaauacccccggugauguuuuguuugauuugaguuuggguccccaucuuaauccuuucuugcuccaucuaucacaaauguauaaugguuggguugguaacaugagagucaggauuaugcuagcugguaaugccuuuacugcggggaagauaauaguuuccugcauacccccugguuuugguucacauaaucuuacuauagcacaagcaacucucuuuccacaugugauugcugauguuaggacucuagaccccauugaggugccuuuggaagauguuaggaauguucucuuucauaauaaugauagaaaucaacaaaccaugcgccuugugugcaugcuguacaccccccuccgcacugguggugguacuggugauucuuuuguaguugcagggcgaguuaugacuugccccaguccugauuuuaauuucuuguuuuuagucccuccuacgguggagcagaaaaccaggcccuucacacucccaaaucugccauugaguucucugucuaacucacgugccccucucccaaucaguaguaugggcauuuccccagacaauguccagagugugcaguuccaaaauggucgguguacucuggauggccgccugguuggcaccaccccaguuucauugucacauguugccaagauaagagggaccuccaauggcacuguaaucaaccuuacugaauuggauggcacacccuuucacccuuuugagggcccugcccccauuggguuuccagaccucggugguugugauuggcauaucaauaugacacaguuuggccauucuagccagacccaguaugauguagacaccaccccugacacuuuugucccccaucuugguucaauucaggcaaauggcauuggcagugguaauuauguugguguucuuagcuggauuucccccccaucacacccgucuggcucccaaguugaccuuuggaagauccccaauuaugggucaaguauuacggaggcaacacaucuagccccuucuguauaccccccugguuucggagagguauuggucuuuuucaugucaaaaaugccagguccuggugcuuauaauuugcccugucuauuaccacaagaguacauuucacaucuugcuagugaacaagccccuacuguaggugaggcugcccugcuccacuauguugacccugauaccggucggaaucuuggggaauucaaagcauacccugaugguuuccucacuuguguccccaauggggcuagcucggguccacaacagcugccgaucaauggggucuuugucuuuguuucauggguguccagauuuuaucaauuaaagccugugggaacugccagcucggcaagagguaggcuuggucugcgccgauaa

SEQ ID NO: 4582 - RNA, 1593 nt, Artificial Sequence; identical to SEQ ID NO: 4573
  capsid_protein_VP1__Norovirus__AGM33241

SEQ ID NO: 4583 - RNA, 1593 nt, Artificial Sequence; identical to SEQ ID NO: 4574
  capsid_protein_VP1__Norovirus__AGM33244

SEQ ID NO: 4584 - RNA, 1626 nt, Artificial Sequence
  capsid_protein_VP1__Norovirus__AGO59890
augaggaugagugauggcgcagcgccaaaagccaauggcucugaggccagcggccaggaucuuguuccugccgccguugaacaggccguccccauucaacccguggcuggcgcggcucuugccgcccccgccgccgggcaaauuaaccaaauugaccccuggaucuuccaaaauuuuguccagugcccccuuggugaguuuuccauuucgccucgaaacaccccaggugaaauacuguuugauuuggcccucgggccagggcuuaaccccuaccuugcccaccucucagccauguacaccggcuggguugggaacauggagguucagcugguccucgccggcaaugccuuuacugcuggcaaggugguuguugcccuuguaccacccuauuuucccaaggggucacucaccacugcccagaucacaugcuuuccacaugucaugugugaugugcgcacccuggagcccauucaacucccucuucuugaugugcgucgaguccuuuggcaugcuacccaggaucaagaggaaucuaugcgccugguuugcaugcuguacacgccacuccgcacaaacagcccgggugaugagucuuuuguggucucuggccgccuucuuucuaagccggcggcugauuucaauuuugucuaccuaacuccccccauagagagaaccaucuaccggauggucgacuugcccgugauacagccgcggcugugcacgcacgcacguuggccugccccggucuauggucucuugguggacccaucccuccccucaaauccccaguggcagaauggaagggugcacguugaugggacccugcuugguaccaccccaaucuccgguucauggguguccugcuuugcggcggaggcugccuauaaguuccaaucgggcaucggugagguggcgacauucacccugauugagcaggauggaucugccuacguccccggugacagggcagcaccacucgguuaccccgauuucucugggcaacuggagaucgagguccagaccgagaccaccaagacuggagacaagcucaaggucaccacuuuugagaugauucuuggcccaacgaccaacgcggaccaggcccccuaccagggcaggguguucgccagcgucacugcugcggccucucuugacuugguggauggcaggguucgugcggucccaagauccaucuacgguuuucaggacaccaucccugaauacaacgaugggcuacugguuccccuugcccccccaauuggucccuuucuccccggcgagguccuccugagguuccggaccuacaugcgucagaucgacaccgcugacgccgcagcagaggcgauagacugugcacucccccaggaguuugucuccugguucgcgucuaacgcguucaccgugcaguccgaggcccugcuccuuagauacaggaacacccugacugggcaacugcuguucgagugcaagcucuacaacgaagguuacaucgccuugucuuauuccggcucaggaccccucaccuucccgaccgauggcaucuuugaggucgucaguuggguuccucgccuuuaccaauuggccucugugggaaguuuggcaacaggccgaaugcucaaacaauaa

SEQ ID NO: 4585 - RNA, 1620 nt, Artificial Sequence
  capsid_protein_VP1__Norovirus__AGT17782
augaagauggcgucgaaugacgcuaccccaucugauggguccucggccaaccucgucccagaggucaacaaugagguuauggcuuuagaacccguugcuggcgccgcgauugcggcaccuguagcgggccaacaaaauguaauugaccccuggauuagaaauaauuuuguacaagccccugguggagaguuuacaguauccccuagaaacgcuccaggugaaauacuauggagcgcguccuugggcccugauuugaaccccuaccuuucccacuugucuagaauguauaaugguuaugcagguaguuuugaagugcagguaauccucgcggggaacgcguucaccgcugggaaaaucauauuugcagcagucccaccaaauuuccgaacugaaggcuugagccccagccagaucaccauguucccccacauaauaacagauguuagacaauuggaaccuguguugauccccuugccugauauuaggaauaauuucuaccauuauaaucaaucaaaugaccccacuauuaaauugauagcaaugcuguauacaccacuuagggccaauaaugcuggggaugauguuuucacagucucuugccgaguucucacaaggccaucccccgauuuugauuucauauuucuggugccacccacaguugaaucaagaacuaaaccauucucugucccaguccuaacuguugaggagaugaccaacucaagauucccuauuccuuuggaaaaguuguucacgggcccuagcagugccuuuguuguucagccacaaaaugguagaugcacgaccgauggcgugcucuuagguaccacccaacugucuccugucaacaucugcaccuucaggggggaugucacccgcauuggaaauucucgcgaguacagaaugaaccuggccucccuaaauuggaacaauuaugacccaacagaagaaaucccagccccccugggaaccccagauuuugcagguaagauccaaggugugcucacccagaccacaaggcaugauggcucgacccgcggucacaaagccacgguguacacuggaagugccggauucaccccaaagcuaggcaguguucaauucuccacugacacagacaaugaccuugaggccaaccaaaacacgagguucaccccagucggugucauccaggacggcaacgcccaccaaggagaaccucagcaaugggugcucccaaacuaugcaggcagagauggucacaauguacaccuagccccugccguggcccccacuuucccgggugagcaacuucucuucuuuagguccaccaugcccggguguagcggguaucccaauaugaauuuggacugccuacucccccaggagugggugcagcacuucuaccaagagucagccccagcacaauccgauguggcauuacuuagauuugugaauccagacacagguaggguuuuguuugagugcaaacuucauaaaucaggcuacgugacaguggcucacacuggcccacaugauuugguuaucccccccaauggcuauuuuagauuugauuccugggucaaccaguucuacacacuugcccccaugggaaauggagcggggcguaggcgugcauuauaa

SEQ ID NO: 4586 - RNA, 1593 nt, Artificial Sequence; identical to SEQ ID NO: 4573
  capsid_protein_VP1__Norovirus__AGT17785

SEQ ID NO: 4587 - RNA, 1623 nt, Artificial Sequence
  capsid_protein_VP1__Norovirus__AGT17788
augaagauggcgucgaaugacgccaacccaucugauggguccgcagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguucacaguauccccuagaaacgcuccaggugaaauacuauggagcgcgcccuuaggcccugaucuaaaccccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaauuucuaccauuauaaucagucaaaugauucuacuauuaaauugauagcaaugcuguauacaccacuuagggcuaauaaugcuggggaugaugucuuuacaguuucuugucgaguucucacgagaccaucccccgauuuugauuucauauuuuuagugccaccuacaguugaaucaagaacuaaaccauucucugucccaauuuuaacuguugaagaaaugaccaauucaagguuccccauuccuuuggaaaaguuguucacgggccccaguaguaccuuuguuguucaaccacaaaacggcaggugcacgacugauggcgugcuccuagguaccacccaacugucuccugucaacaucugcaccuucagaggggaugucacccacauuacaggcagucguaacuacacaaugaaccuggcuucccaaaauuggaacaguuaugacccaacagaagaaaucccagccccucuaggaacuccagauuucguggggaagauucaaggugugcucacucaaaccacaaggacagauggcucgacccgcggccacaaagcuacaguguacacugggagcgccgacuuuucuccaaaacuggguagaguucaauuugccacugacacagacaaugauuucgaugcuaaccaaaacacuaaguucaccccagucgguguuauccaggaugguggcacuacccaccgaaaugaaccccaacaaugggugcucccaaguuacucaggcagaaacacucauaaugugcaccuggcccccgcuguagcccccacuuuuccgggugagcaacuccucuucuucagaucuaccaugccaggaugcagcggguaccccaacauggauuuggacugucugcucccccaggaaugggugcagcauuucuaccaggaagcagccccagcacaaucugauguggcucugcuaagauuugugaauccagacacagguaggguucuguuugaguguaagcuucauaaaucaggcuauguuacaguggcucacacuggucaacaugauuugguuaucccccccaaugguuauuuuagauuugauuccugggucaaccaguucuacacacuugccccuaugggaaaugggacggggcguagacgugcaguauaa

SEQ ID NO: 4588 - RNA, 1593 nt, Artificial Sequence; identical to SEQ ID NO: 4573
  capsid_protein_VP1__Norovirus__AGT17792

SEQ ID NO: 4589 - RNA, 1623 nt, Artificial Sequence
  capsid_protein_VP1__Norovirus__AGT17795
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguguccccuagaaacgcuccaggugagauacuauggagcgcgcccuuaggcccugauuugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccacuauaaucagucaaaugaccccaccaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacagcuacgauccaacagaagaaaucccagccccccuaggaacuccagauuucguggggaagauucaaggugugcucacccaaaccacaaggacagauggcucgacccgcggccacaaagcuacaguguacacugggagcgccgacuuuucuccaaaacuggguaggguucaauuugccacugacacagacaaugauuuuguaauuaaccaaaacacaaaguucaccccagucgguguuauccaggaugguaguacuaccccccgaaaugaaccccaacaaugggugcucccaaguuacucaggcagaaacacucacaaugugcaccuggcccccgcuguagcccccacuuucccgggcgagcaacuccucuucuucagaucuaccaugcccggaugcagcggguaccccaacauggauuuggacugucugcucccccaggaaugggugcaguauuucuaccaggaggcagccccagcacaaucugauguggcacuguuaagauuugugaacccagauacagguagggucuuguuugaguguaagcuucauaaaucaggcuauguuacaguggcucacacuggccaacaugauuuaguuaucccccccaaugguuauuuuagguuugauuccugggucaaccaguucuacacacuugcccccaugggaaaugggacggggcguagacgugcauuauaa

SEQ ID NO: 4590 - RNA, 1617 nt, Artificial Sequence
  capsid_protein_VP1__Norovirus__AGT17798
augaagauggcgucgagugacgccaacccaucugauggguccacagccaaccucgucccagaggccaacaaugagguuauggcuuuggagcccguuguuggugccgccauugcggcgccuguagcgggccaacaaaauguaauugaccccuggauuagaaacaauuuugugcaagccccugguggagaguuuacaguauccccuagaaacgcuccaggugaaguacuauggagcgcgcccuuaggcccugauuugaaucccuaccuuucccauuuggccagaauguacaaugguuaugcaggugguuuugaagugcagguaauccucgcggggaacgcguucgccgccggaaaaaucauauucgcagcagucccaccaaauuucucaacugaaggcuugagccccagccaggucacuauguucccccacuuaauaguagauguuaggcaacuggaaccugugaugauccccuuacccgauauuaggaauaauuucuaucauuacaaucaaucaaaugaucccaccaucaaauugauagcaauguuguauacaccucuuagggcuaauaauguuggugacgaugucuucacaguuucuugucggguacucacgagaccaucccccgauuuugauuucauauuucuagugccacccacaguugaaucaaaaaccaacccauucucuguuccaauucuaacuauugaggagaugaccaauucaagauuccccauuccuuuggaaaaguuguucacgggccccagcagugcccuuguuguucaaccacaaaacggcaggugcacgacugauggcgugcuccuggguaccacccaacugucuccugucaacaucugcaccuucagaggggaugucacccauacuacaaaaacucauaccuaccaaaugaauuuggcugcucaaaauuggaacaguuaugacccaacagaagaaaccccagccccccuaggaacuccagauuucgugggaaagauccaaggugugcucacccaaaccacgaagggaaauggcucaacccgugcccacaaagcuacaguguacacugggaccgucgaguucacuccaaaacuggguagaauccaacuuuucacugacacagacaacgaucuugaagcuaaccaaaacacaaaguucaccccagucggugucauccaggauggugaccaccaaaaugaaccccaacaauggguacucccaaguuacucagguagaaauaaucacaaugugcaccuggcccccgcuguagcccccacuuuuccgggcgagcaacuucucuucuucagauccacuaugcccggaugcagcggguaccccaacaugaauuuggacugucugcuuccccaggaaugggugcaauauuucuaucaagaggcagccccagcacaaucugauguggcuuugcuaagauuugugaauccagauacagguaggguuuuguuugagugcaagcuucauaaaucagguuaugucacaguggcccacaccggccaccaugauuugguuauccccccuaaugguuauuucagauuugauuccugggucagccccuucuacacgcuugcccccaugggaaauggaacggggcguagacgugcauuauaa

SEQ ID NO: 4591 - RNA, 1593 nt, Artificial Sequence; identical to SEQ ID NO: 4573
  capsid_protein_VP1__Norovirus__AGT17803

SEQ ID NO: 4592 - RNA, 1593 nt, Artificial Sequence; identical to SEQ ID NO: 4573
  capsid_protein_VP1__Norovirus__AGT17806

SEQ ID NO: 4593 - RNA, 1593 nt, Artificial Sequence; identical to SEQ ID NO: 4573
  capsid_protein_VP1__Norovirus__AGT17809

SEQ ID NO: 4594 - RNA, 1623 nt, Artificial Sequence
  capsid_protein_VP1__Norovirus__AGT17813
augaagauggcgucgaaugacgccaacccaucugauggguccgcagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguucacaguauccccuagaaacgcuccaggugaaauacuauggagcgcgcccuuaggcccugaucuaaaccccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaauuucuaucauuauaaucagucaaaugauucuaccauuaaauugauagcaaugcuguauacaccacuuagggcuaauaaugcuggggaugaugucuuuacaguuucuugucgaguucucacgagaccaucccccgauuuugauuucauauuuuuagugccaccuacaguugaaucaagaacuaaaccauucucugucccaauuuuaacuguugaagaaaugaccaauucaagguuccccauuccuuuggaaaaguuguucacgggccccaguaguaccuuuguuguucaaccacaaaacggcaggugcacgacugauggcgugcuccuagguaccacccaacugucuccugucaacaucugcaccuucagaggggaugucacccacauugcaggcagucguaacuacacaaugaaccuggcuucccaaaauuggaacaguuaugacccaacagaagaaaucccagccccucuaggaacuccagauuucguggggaagauucaaggugugcucacucaaaccacaaggacagauggcucgacccgcggccacaaagcuacaguguacacugggagcgccgacuuuucuccaaaacuggguagaguucaauuugccacugacacagacaaugauuucgaugcuaaccaaaacacuaaguucaccccagucgguguuauccaggaugguggcacugcccaccgaaaugaaccccaacaaugggugcucccaaguuacucaggcagaaacacucauaaugugcaccuggcccccgcuguagcccccacuuuuccgggugagcaacuccucuucuucagaucuaccaugccaggaugcagcggguaccccaacauggauuuggacugucugcucccccaggaaugggugcaguauuucuaccaggaagcagccccagcacaaucugauguggcucugcuaagauuugugaauccagacacagguaggguucuguuugaguguaagcuucauaaaccaggcuauguuacaguggcucacacuggucaacaugauuugguuaucccccccaaugguuauuuuagauuugauuccugggucaaccaguucuacacacuugccccuaugggaaaugggacggggcguagacgugcauuauaa

SEQ ID NO: 4595 - RNA, 1623 nt, Artificial Sequence
  capsid_protein_VP1__Norovirus__AGT17816
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaguaacuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgcgggaaaaaucauauuugcagcaguuccaccaaauuuuccaacugaaggcuugagucccagccaaguuacuauguucccccacauaauaguagauguuaggcaauuggaaccuguguugauccccuuaccugauguuaggaauaacuucuaucacuauaaccagucaaaugauucuaccauuaaauugauagcaaugcuguacacaccacucagagccaauaaugccggggaugaugucuucacggucucuugucgaguccucacgaggccauccccugauuuugacuucauauuucuggugccaccuacaguugagucaagaacuaagccauuuacugucccaaucuugacuguugaagaaaugaccaauucaagauuccccauuccuuuggagaaauuguucacgggucccagcagugccuuuguuguucaaccacaaaauggcagaugcacaacugauggcgugcucuuaggcaccacccaacugucuccugucaacaucugcaccuucagaggggaugucacccacauugcggguucccguaauuacacaaugaauuuggccucucuaaauuggagcaauuacgacccaacagaagagauuccagccccucugggaacuccagauuucgugggaaagauccaaggugugcucacucaaaccacaaagggagauggcucgacccggggccauaaagcuacaguuuacacugggagugccgacuucacuccaaagcugggcaguguucaauuugcuacugauacagaaaaugacuuugaaacucaccaaaacacaagauucaccccagucggugucauucaggaugguggcaccacccaccgaaaugaaccccaacaaugggugcucccaaguuacucagguagaaauguccauaauguacaccuagccccugcuguagcccccaauuuuccaggugaacagcuccuuuucuucagguccacuaugcccggauguagcggauaucccaacauggauuuggauugccuacucccccaggagugggugcaacacuuuuaccaagaggcagcuccagcacaaucugauguggcucuauugagauuugugaauccagacacggguagggucuuguuugagugcaaacuccauaaaucaggcuaugucacaguggcucauaccggccaacaugauuuggucauuccccccaaugguuauuuuagguuugauuccuggguuaaucaguucuacacacuugcccccaugggaaauggaacggggcguagacgugcuuuauaa

SEQ ID NO: 4596 - RNA, 1623 nt, Artificial Sequence
  capsid_protein_VP1__Norovirus__AGT17819
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugagauacuauggagcgcgcccuuaggcccugauuugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccacuauaaucagucaaaugaccccaccaucaaauugauagcaauguuguacacaccacuuagggcuaacaaugccggggacgaugucuucacaguuucuugucgaguucucacgagaccaucccccgauuuugacuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguaccacccaacugucuccugucaacaucugcaccuucagaggggaugucacccacauugcaggcagucguaacuacacaaugaauuuggccucccaaaauuggaacagcuacgauccaacagaagaaaucccagccccccuaggaacuccagauuucguggggaagauucaaggugugcucacccaaaccacaaggacagauggcucgacccgcggccacaaagcuacaguguacacugggagcgccgacuuuucuccaaaacuggguaggguucaauuugccacugacacagacaaugauuuuguaacuaaccaaaacacaaaguucaccccagucggugucauccaggauggugguacuaccccccgaaaugaaccccaacaaugggugcucccaaguuacucaggcagaaacacucacaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaagcagccccggcacaaucugauguggcacuguuaagauuugugaacccagacacagguagggucuuguuugaguguaaacuucauaaaucaggcuauguuacaguggcucacacuggccaacaugauuuaguuaucccccccaaugguuauuuuagauuugauuccugggucaaccaguucuacacacuugcccccaugggaaaugggacggggcgcagacgugcauuauaa

SEQ ID NO: 4597 - RNA, 1623 nt, Artificial Sequence
  capsid_protein_VP1__Norovirus__AGT17823
augaagauggcgucgagugacgccaacccaucugauggguccacagccaaccucguuccagaggucaacaaugagguuauggcuuuggagcccguuguuggugccgccauugcggcgccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccauauaauaguagauguuaggcaacuggaaccuuuguugauccccuuacccgauguuaggaauaauuucuaucacuacaaucaaucaaaugaccccacuaucaaauugauagcaauguuguauacaccucuuagggcuaauaaugcuggggacgaugucuucacaguuucuugucggguacucacgagaccaucccccgauuuugauuucauauuucuagugccacccacaguugaaucaagaacuaaaccauucucugucccaauuuuaacuauugaggagaugaccaauucaagauuccccauuccuuuggaaaagcuguucacgggccccagcagugccuuuguuguucaaccacaaaacggcaggugcacgacugauggcgugcuccuagguaccacccaacugucuccugucaacaucugcaccuucagaggggaugucacccauauuacagguacucauaacuacgcaaugaauuuggcugcucaaaauuggaacaguuaugacccaacagaagaaaucccagccccucuaggaacuccagauuucgugggaaagauccaaggugugcucacccaaaccacgagggcagauggcucaacccgugcccacaaagcuacaguguacacugggagcgccgaauuugcuccaaaacuggguagaguccaauuugccacugacacagacagugauuuugauacuaaccaaaacacaaaguucaccccagucggugucauccaggaugguaauacugcccaccaaaaugaaccccaacaauggguacucccaaguuacucaggcagaaauaaucacaaugugcaccuggcccccgcuguagcccccacuuuuccgggcgagcaacuucucuucuucagauccacuaugcccggaugcagcggguaccccaacaugaauuuggacugucugcuuccccaggaaugggugcaauauuucuaucaagaggcagccccagcacaaucugauguggcucugcuaagauuugugaauccagacacagguaggguuuuguuugaguguaagcuucauaaaucagguuaugucacaguggcucacaccggccaacaugauuugguuaucccccccaaugguuauuucagauuugauuccugggucagccccuucuacacacuugcccccaugggaaauggaacggggcguagacgugcauuauaa

SEQ ID NO: 4598 - RNA, 1593 nt, Artificial Sequence; identical to SEQ ID NO: 4573
  capsid_protein_VP1__Norovirus__AGT17826

SEQ ID NO: 4599 - RNA, 1620 nt, Artificial Sequence
  capsid_protein_VP1__Norovirus__AGT17830
augaagauggcgucgaaugacgcuaccccaucugauggguccucggccaaccucgucccagaggccaacaaugagguuauggcuuuagaacccguugcuggcgccgcgauugcggcaccuguagcgggccaacaaaauguaauugaccccuggauuagaaauaauuuuguacaagccccugguggagaguuuacaguauccccuagaaacgcuccaggugaaauacuauggagcgcguccuugggcccugauuugaaccccuaccuuucccacuugucuagaauguauaaugguuaugcagguaguuuugaagugcagguaauccucgcggggaacgcguucaccgcugggaaaaucauauuugcagcagucccaccaaauuuccgaacugaaggcuugagccccagccagaucaccauguucccccacauaauaacagauguuagacaauuggaaccuguguugauccccuugccugauauuaggaacaauuucuaccauuauaaucaaucaaaugaccccacuauuaaauugauagcaaugcuguauacgccacuuagggccaauaaugcuggggaugauguuuucacagucucuugccgaguucucacaaggccaucccccgauuuugauuucauauuucuggugccacccacaguugaaucaagaacuaaaccauucucugucccaguccuaacuguugaggagaugaccaacucaagauucccuauuccuuuggaaaaguuguucacgggcccuagcagugccuuuguuguucagccacaaaaugguagaugcacgacugauggcgugcucuuagguaccacccaacugucuccugucaacaucugcaccuucaggggggaugucacccgcauuggaaauucucgcgaguacagaaugaaccuggccucccuaaauuggaacaauuaugacccaacagaagaaaucccagccccccugggaaccccagauuuugcaggcaagauccaaggugugcucacccagaccacaaggcaugacgguucgacccgcggucacaaagccacgguguacacuggaagugccggauucaccccaaagcuaggcaguguucaauucuccacugacacagacaaugaccuugaggccaaccaaaacacgagguucaccccagucggugucauccaggacggcaacgcccaccaaggagaaccucagcaaugggugcucccaaacuaugcaggcagagauggucacaauguacaccuagccccugccguggcccccacuuucccgggugagcaacuucucuucuuuagguccaccaugcccggguguagcggguaucccaauaugaauuuggacugccuacucccccaggagugggugcagcacuucuaccaagagucagccccagcacaauccgacguggcauuacuuagauuugugaauccagacacagguaggguuuuguuugagugcaaacuucauaaaucaggcuacgugacaguggcucacacuggcccacaugauuuggucaucccccccaauggcuauuuuagauuugauuccugggucaaccaguucuacacacuugcccccaugggaaauggagcggggcguaggcgugcauuauaa

SEQ ID NO: 4600 - RNA, 1623 nt, Artificial Sequence
  capsid_protein_VP1__Norovirus__AGT17833
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguguccccuagaaacgcuccaggugaaauacuauggagcgcgcccuuaggcccugauuugaaucccuaccuuucccauuuggccagaauguacaacgguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucagucaaaugacuccaccaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauugcaggcagucgcaacuacacaaugaauuuggccucccaaaauuggaacaguuacgauccgacagaagaaaucccagccccccuaggaacuccagauuucguggggaagauucaaggugugcucacccaaaccacaaggacagauggcucgacccgcggccacaaagcuacaguguacacugggagcgccgacuuuucuccaaaacuggguaggguucaauuugccacugacacagacaaugauuuuguaacuaaucagaauacaaaguucaccccagucgguguuauccaggauggcaguacuaccccccgaaaugaaccccaacaaugggugcucccaaguuacucaggcagaaacacucauaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacgugcauuauaa

SEQ ID NO: 4601 - RNA, 1593 nt, Artificial Sequence; identical to SEQ ID NO: 4573
  capsid_protein_VP1__Norovirus__AGT17836

SEQ ID NO: 4602 - RNA, 1620 nt, Artificial Sequence
  capsid_protein_VP1__Norovirus__AGT17842
augaagauggcgucgagugacgccaacccaucugauggguccacagccaaccucgucccagaggucaacaaugagguuauggcuuuggagcccguuguuggugccgccauugcggcgccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccggccagguuacuauguucccccauauaauaguagauguuaggcaacuggaaccuguguugauccccuuacccgauguuaggaauaauuucuaucacuacaaucaaucaaaugaccccaccaucaaauugguagcaauguuguauacaccucuuagggcuaauaaugcuggggacgaugucuucacaguuucuugucggguacucacgagaccaucccccgauuuugauuucauauuuuuagugccacccacaauugaaucaaaaacuaaaucauucucugucccaauuuuaacuauugaggagaugaccaauucaagauuccccauuccuuuggaaaagcuguucacgggccccagcaguacccuuguuguucaaccacaaaauggcaggugcacgacugauggcgugcuccuagguaccacccaacugucuccugucaacaucugcaccuucagaggggacgucacccaaauuacaaauacucacagcuacgaaaugaauuuggcugcucaaaauuggaacaguuaugacccaacagaagaaaucccagccccccuaggaacuccagauuucgugggaaagauccaaggugugcucacccaaaccacgaaggaaaauggcucaacccgugcccacaaagcuacaguguacacugggagcaccggauuuacuccaaaacuggguagaguccaauuugucacugacacagacagagaucuugaaacuaaccaagacacaaaguucaccccagucggugucauccaggauggugaugcccaccaaaaugaaccccaacaauggguacucccaaguuacuuagguacaaauaaucacaaugugcaccuggcccccgcuguagcccccacuuuuccgggcgagcaacuucucuucuucagauccacuaugcccggaugcagcggguaccccaacaugaauuuggacugucugcuuccccaggaaugggugcaauauuucuaucaagaggcagccccagcacaaucugauguggcuuugcuaagauuugugaauccagacacagguaggguuuuguuugaguguaagcuucauaaaucagguuaugucacaguggcucacaccggccgccaugauuugguuaucccccccaaugguuauuucagauuugauuccugggucagccccuucuacacacuugcccccaugggaaauggaacggggcguagacgugcauuauaa

SEQ ID NO: 4603 - RNA, 1623 nt, Artificial Sequence
  capsid_protein_VP1__Norovirus__AGU68328
augaagauggcgucgagugacgccaacccaucugauggguccgcagccaaccucguaccagaggucaacaaugagguuauggcucuggagcccguuguuggugccgcuauugcggcaccuguagcgggccaacaaaauguaauugaccccuggauuagaaacaauuuuguacaagccccugguggagaguuuacaguguccccuagaaacgcuccaggugaaauacuauggagcgcgcccuuaggcccugaucuaaaucccuaccuaucccauuuggcuagaauguacaaugguuaugcaggugguuuugaagugcagguaauucucgcggggaacgcguucgccgccgggaagaucauauuugcagcagucccaccaaauuuuccaacugaaggcuuaagccccagccaggucacuauguucccccauauaauaguagauguuagacaacuagaaccugugcugauucccuuacccgaugucaggaauaauuucuaucauuacaaucaaucaaaugauuccacuauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggucccagcagugccuuuguuguucaaccacaaaacggcaggugcacgacugauggcgugcuccuaggcaccacccaacugucuccugucaacaucugcacccucagaggggaugucacccacaucacagguagucguaacuacacaaugaauuuggcuucucaaaauuggaacaauuaugacccaacagaagaaaucccagccccucuaggaacuccagauuuuguggggaagauucaaggcaugcucacucaaaccacaaggacagaugguucaacacgcgguuacaaagcuacaguguacacugggagcgccgacuuugcuccaaaacuggguagaguucaauuugaaacugacacagaccaugauuuugaagcuaaccaaaacacaaaguucaccccagucggugucauccaagaugguagcaccacccaccgaaaugaaccccagcagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaggaggcagccccagcacaaucugauguggcucugcuaagauuugugaauccagacacagguaggguuuuguuugaguguaagcuucacaaaucaggcuauguuacaguggcucacacuggccaacaugauuugguuaucccccccaacgguuacuuuagguuugauuccugggucaaccaguucuacacgcuugcccccaugggaaauggaacggggcguagacguguaguauaa

SEQ ID NO: 4604 - RNA, 1620 nt, Artificial Sequence
  capsid_protein_VP1__Norovirus__AGX85889
augaagauggcgucgagugacgccaacccaucugauggguccacagccaaccucgucccagaggccaacaaugagguuauggcuuuggagcccguuguuggugccgcuauugcggcaccuguagcgggccaacaaaauguaauugaccccuggauuagaaauaauuuuguacaagccccugguggagaguucacaguauccccuagaaacgcuccaggugaaauacuauggagcgcgcccuuaggcccugaucuaaaccccuaucuaucucauuuguccagaauguauaaugguuaugcaggugguuuugaagugcagguaauccucgcggggaacgcguucgccgccggaaaaaucauauucgcagcagucccaccaaauuucccaacugaaggcuugagccccagccaggucacuauguucccccacuuaauaguagauguuaggcaacuggaaccugugaugauccccuuacccgauauuaggaauaauuucuaucauuacaaucaaucaaaugaucccaccaucaaauugauagcaauguuguauacaccucuuagggcuaauaauguuggugacgaugucuucacaguuucuugucggguacucacgagaccaucccccgauuuugauuucauauuucuagugccacccacaguugaaucaaaaaccaacccauucucuguuccaauucuaacuauugaggagaugaccaauucaagauuccccauuccuuuggaaaagcuguucacgggccccagcagugcccuuguuguucaaccacaaaacggcaggugcacgacugauggcgugcuccuggguaccacccaacugucuccugucaacaucugcaccuucagaggggaugucacccauacuacaaaaacucauaccuaccaaaugaauuuggcugcucaaaauuggaacaguuaugacccaacagaagaaaucccagccccccuaggaacuccagauuucgugggaaagauccaaggugugcucacccaaaccacgaagggaaauggcucaacccgugcccacaaagcuacaguguacacugggagcgccgaguucacuccaaaacuggguagaauccaacuuuucacugacacagacaacgaucuugaagcuaaccaaaacacaaaguucaccccagucggugucauccaggauggugauacccaccaaaaugaaccccaacaauggguacucccaaguuacucagguagaaauaaucacaaugugcaccuggcccccgcuguagcccccacuuuuccgggcgagcaacuucucuucuucagauccacuaugcccggaugcagcggguaccccaacaugaauuuggacugucugcuuccccaggaaugggugcaauauuucuaucaagaggcagccccagcacaaucugauguggcuuugcuaagauuugugaauccagauacagguaggguuuuguuugagugcaagcuucauaaaucagguuaugucacaguggcucacaccggccaccaugauuuguuuauccccccuaaugguuauuucagauuugauuccugggucagccccuucuacacacuugcccccaugggaaauggaacggggcguagacgugcauuauaa

SEQ ID NO: 4605 - RNA, 1620 nt, Artificial Sequence
  capsid_protein_VP1__Norovirus__AGX85892
augaagauggcgucgagugacgccaacccaucugauggguccacagccaaccucgucccagaggccaacaaugagguuauggcuuuggagcccguuguuggugccgccauugcggcgccuguagcgggccaacaaaauguaauugaccccuggauuagaaacaauuuugugcaagccccugguggagaguuuacaguauccccuagaaacgcuccaggugaaguacuauggagcgcgcccuuaggcccugauuugaaucccuaccuuucccauuuggccagaauguacaaugguuaugcaggugguuuugaagugcagguaauccucgcggggaacgcguucgccgccggaaaaaucauauucgcagcagucccaccaaauuucccaacugaaggcuugagccccagccaggucacuauguucccccacuuaauaguagauguuaggcaacuggaaccugugaugauccccuuacccgauauuaggaauaauuucuaucauuauaaucaaucaaaugaucccaccaucaaauugauagcaauguuguauacaccucuuagggcuaauaauguuggugacgaugucuucacaguuucuugucggguacucacgagaccaucccccgauuuugauuucauauuucuagugccacccacaguugaaucaaaaaccaacccauucucuguuccaauucuaacuauugaggagaugaccaauucaagauuccccauuccuuuggaaaagcuguucacgggccccagcagugcccuuguuguucaaccacaaaacggcaggugcacgacugauggcgugcuccuggguaccacccaacugucuccugucaacaucugcaccuucagaggggaugucacccauacuacaaaaacucauaccuaccaaaugaauuuggcugcucaaaauuggaacaguuaugacccaacagaagaaaucccagccccccuaggaacuccagauuucgugggaaagauccaaggugugcucacccaaaccacgaagggaaauggcucaacccgugcccacaaagcuacaguguacacugggggcgucgaguucacuccaaaacuggguagaauccaacuuuucacugacacagacaacgaucuugaagcuaaccaaaacacaaaguucaccccagucggugucauccaggauggugauacccaccaaaaugaaccccaacaauggguacucccaaguuacucagguagaaauaaucacaaugugcaccuggcccccgcuguagcccccacuuuuccgggcgagcaacuucucuucuucagauccacuaugcccggaugcagcggguaccccaacaugaauuuggacugucugcuuccccaggaaugggugcaauauuucuaucaagaggcagccccagcacaaucugauguggcuuugcuaagauuugugaauccagauacagguaggguuuuguuugagugcaagcuucauaaaucagguuaugucacaguggcucacaccggccaccaugauuuguuuauccccccuaaugguuauuucagauuugauuccugggucagccccuucuacacacuugcccccaugggaaauggaacggggcguagacgugcauuauaa

SEQ ID NO: 4606 - RNA, 1620 nt, Artificial Sequence
  capsid_protein_VP1__Norovirus__AGX85895
augaagauggcgucgagugacgccaacccaucugauggguccacagccaaccucgucccagaggccaacaaugagguuauggcuuuggagcccguuguuggugccgccauugcggcgccuguagcgggccaacaaaauguaauugaccccuggauuagaaacaauuuugugcaagccccugguggagaauuuacaguauccccuagaaacgcuccaggugaaguacuauggagcgcgcccuuaggcccugauuugaaucccuaccuuucucauuuggccagaauguacaaugguuaugcaggugguuuugaagugcagguaauccucgcggggaacgcguucgccgccggaaaaaucauauucgcagcagucccaccaaauuucccaacugaaggcuugagccccagccaggucacuauguucccccacuuaauaauagauguuaggcaacuggaaccugugaugauccccuuacccgauguuaggaauaauuucuaucauuacaaucaaucaaaugaucccaccaucaaauugauagcaauguuguauacaccucuuagggcuaauaauguuggugacgaugucuucacaguuucuugucggguacucacgagaccaucccccgauuuugauuucauauuucuagugccacccacaguugaaucaaaaaccaacccauucucuguuccaauuuuaacuauugaggagaugaccaauucaagauuccccauuccuuuggaaaagcuguucacgggccccagcagugcccuuguuguucaaccacaaaacggcaggugcacgacugauggcgugcuccuagguaccacccaacugucuccugucaacaucugcaccuucagaggggaugucacccauauuacaaaaacucauagcuaccaaaugaauuuggcugcucaaaauuggaacaguuaugacccaacagaagaaaucccagccccccuaggaacuccagauuucgugggaaagauccaaggugugcucacccaaaccacgaagggaaauggcucaacccgugcccacaaagcuacaguguacacugggagcaccgaauucacuccaaaacuggguagaauccaacuugucacugacacagacaacgaucuugaaacuaaccaaaacacaaaguucaccccagucggugucauccaggauggugauacccaccaaaaugaaccccaacaauggguacucccaaguuacuuagguagaaauaaucacaaugugcaccuggcccccgcuguagcccccacuuuuccgggcgagcaacuucucuucuucagauccacuaugcccggaugcagcggguaccccaacaugaauuuggacugucugcuuccccaggaaugggugcaauauuucuaucaagaggcagccccagcacaaucugauguggcuuugcuaagauuugugaauccagauacagguaggguuuuguuugagugcaagcuucauaaaucagguuaugucacaguggcucacaccggccaccaugauuuguuuaucccccccaaugguuauuucagauuugauuccugggucagccccuucuacacacuugcccccaugggaaauggaacggggcguagacgugcauuauaa

SEQ ID NO: 4607 - RNA, 1623 nt, Artificial Sequence
  capsid_protein_VP1__Norovirus__AGX85904
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaguaacuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgcgggaaaaaucauauuugcagcaguuccaccaaauuuuccaacugaaggcuugagucccagccaaguuacuauguucccccacauaauaguagauguuaggcaauuggaaccuguguugauccccuuaccugauguuaggaauaacuucuaucacuauaaccagucaaaugauucuaccauuaaauugauagcaaugcuguacacaccacucagagccaauaaugccggggaugaugucuucacggucucuugucgaguccucacgaggccauccccugauuuugacuucauauuucuggugccaccuacaguugagucaagaacuaagccauuuacugucccaaucuugacuguugaagaaaugaccaauucaagauuccccauuccuuuggagaaauuguucacgggucccagcagugccuuuguuguucaaccacaaaauggcagaugcacaacugauggcgugcucuuaggcaccacccaacugucuccugucaacaucugcaccuucagaggggaugucacccacauugcggguucccguaauuacacaaugaauuuggccucucuaaauuggagcaauuacgacccaacagaagagauuccagccccucugggaacuccagauuucgugggaaagauccaaggugugcucacucaaaccacaaagggagauggcucgacccggggccauaaagcuacaguuuacacugggagugccgacuucacuccaaagcugggcaguauucaauuugcuacugauacagaaaaugacuuugaaacucaccaaaacacaagauucaccccagucggugucauucaggaugguggcaccacccaccgaaaugaaccccaacaaugggugcucccaaguuacucagguagaaauguccauaauguacaccuagccccugcuguagcccccaauuuuccaggugaacagcuccuuuucuucagguccacuaugcccggauguagcggauaucccaacauggauuuggauugccuacucccccaggagugggugcaacacuuuuaccaagaggcagcuccagcacaaucugauguggcucuauugagauuugugaauccagacacggguagggucuuguuugagugcaaacuccauaaaucaggcuaugucacaguggcucauaccggccaacaugauuuggucauuccccccaaugguuauuuuagguuugauuccuggguuaaucaguucuacacacuugcccccaugggaaauggaacggggcguagacgugcuuuauaa

SEQ ID NO: 4608 - RNA, 1617 nt, Artificial Sequence
  capsid_protein_VP1__Norovirus__AGX85913
augaagauggcgucgagugacgccaacccaucugauggguccacagccaaccucgucccagaggccaacaaugagguuauggcuuuggagcccguuguuggugccgccauugcggcgccuguagcgggccaacaaaauguaauugaccccuggauuagaaacaauuuugugcaagccccugguggagaguuuacaguauccccuagaaacgcuccaggugaaguacuauggagcgcgcccuuaggcccugauuugaaucccuaccuuucccauuuggccagaauguacaaugguuaugcaggugguuuugaagugcagguaauccucgcggggaacgcguucgccgccggaaaaaucauauucgcagcagucccaccaaauuucucaacugaaggcuugagccccagccaggucacuauguucccccacuuaauaguagauguuaggcaacuggaaccugugaugauccccuuacccgauauuaggaauaauuucuaucauuacaaucaaucaaaugaucccaccaucaaauugauagcaauguuguauacaccucuuagggcuaauaauguuggugacgaugucuucacaguuucuugucggguacucacgagaccaucccccgauuuugauuucauauuucuagugccacccacaguugaaucaaaaaccaacccauucucuguuccaauucuaacuauugaggagaugaccaauucaagauuccccauuccuuuggaaaagcuguucacgggccccagcagugcccuuguuguucaaccacaaaacggcaggugcacgacugauggcgugcuccuggguaccacccaacugucuccugucaacaucugcaccuucagaggggaugucacccauacuacaaaaacucauaccuaccaaaugaauuuggcugcucaaaauuggaacaguuaugacccaacagaagaaaucccagccccccuaggaacuccagauuucgugggaaagauccaaggugugcucacccaaaccacgaaggaaaauggcucaacccgugcccacaaagcuacaguguacacugggaccgucgaguucacuccaaaacuggguagaauccaacuuuucacugacacagacaacgaucuugaagcuaaccaaaacacaaaguucaccccagucggugucauccaggauggugaccaccaaaaugaaccccaacaauggguacucccaaguuacucagguagaaauaaucacaaugugcaccuggcccccgcuguagcccccacuuuuccgggcgagcaacuucucuucuucagauccacuaugcccggaugcagcggguaccccaacaugaauuuggacugucugcuuccccaggaaugggugcaauauuucuaucaagaggcagccccagcacaaucugauguggcuuugcuaagauuugugaauccagauacagguaggguuuuguuugagugcaagcuucauaaaucagguuaugucacaguggcucacaccggccaccaugauuugguuauccccccuaaugguuauuucagauuugauuccugggucagccccuucuacacacuugcccccaugggaaauggaacggggcguagacgugcauuauaa

SEQ ID NO: 4609 - RNA, 1623 nt, Artificial Sequence
  capsid_protein_VP1__Norovirus__AGX85916
augaagauggcgucgaaugacgccaacccaucugauggguccgcagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguucacaguauccccuagaaacgcuccaggugaaauacuauggagcgcgcccuuaggcccugaucuaaaccccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaauuucuaccauuauaaucagucaaaugauucuaccauuaaauugauagcaaugcuguauacaccacuuagggcuaauaaugcuggggaugaugucuuuacaguuucuugucgaguucucacgagaccaucccccgauuuugauuucauauuuuuagugccaccuacaguugaaucaagaacuaaaccauucucugucccaauuuuaacuguugaagaaaugaccaauucaagguuccccauuccuuuggaaaaguuguucacgggccccaguaguaccuuuguuguucaaccacaaaacggcaggugcacgacugauggcgugcuccuagguaccacccaacugucuccugucaacaucugcaccuucagaggggaugucacccacauuacaggcagucguaacuacacaaugaaccuggcuucccaaaauuggaacaguuaugacccaacagaagaaaucccagccccucuaggaacuccagauuucguggggaagauucaaggugugcucacucaaaccacaaggacagauggcucgacccgcggccacaaagcuacaguguacacugggagcgccgacuuuuccccaaaacuggguagaguucaauuugccacugacacagacaaugauuucgauacuaaccaaaacacuaaguucaccccagucgguguuauccaggaugguggcacuacccaccgaaaugaaccccaacaaugggugcucccaaguuacucaggcagaaacacucauaaugugcaccuggcccccgcuguagcccccacuuuuccgggugagcaacuccucuucuucagaucuaccaugccaggaagcagcggguaccccaacauggauuuggacugucugcucccccaggaaugggugcaguauuucuaccaggaagcagccccagcacaaucugauguggcucugcuaagauuugugaauccagacacagguaggguucuguuugaguguaagcuucauaaaucaggcuauguuacaguggcucacacuggucaacaugauuugguuaucccccccaaugguuauuuuagauuugauuccugggucaaccaguucuacacacuugccccuaugggaaaugggacggggcguagacgugcaguauaa

SEQ ID NO: 4610 - RNA, 1617 nt, Artificial Sequence; identical to SEQ ID NO: 4608
  capsid_protein_VP1__Norovirus__AGX85931

SEQ ID NO: 4611 - RNA, 1617 nt, Artificial Sequence
  capsid_protein_VP1__Norovirus__AGX85934
augaagauggcgucgagugacgccaacccaucugauggguccacagccaaccucgucccagaggccaacaaugagguuauggcuuuggagcccguuguuggugccgccauugcggcgccuguagcgggccaacaaaauguaauugaccccuggauuagaaacaauuuugugcaagccccugguggagaguuuacaguauccccuagaaacgcuccaggugaaguacuauggagcgcgcccuuaggcccugauuugaaucccuaccuuucccauuuggccagaauguacaaugguuaugcaggugguuuugaagugcagguaauccucgcggggaacgcguucgccgccggaaaaaucauauucgcagcagucccaccaaauuucucaacugaaggcuugagccccagccaggucacuauguucccccacuuaauaguagauguuaggcaacuggaaccugugaugauccccuuacccgauauuaggaauaauuucuaucauuacaaucaaucaaaugaucccaccaucaaauugauagcaauguuguauacaccucuuagggcuaauaauguuggugacgaugucuucacaguuucuugucggguacucacgagaccaucccccgauuuugauuucauauuucuagugccacccacaguugaaucaaaaaccaacccauucucuguuccaauucuaacuauugaggagaugaccaauucaagauuccccauuccuuuggaaaagcuguucacgggccccagcagugcccuuguuguucaaccacaaaacggcaggugcacgacugauggcgugcuccuggguaccacccaacugucuccugucaacaucugcaccuucagaggggaugucacccauacuacaaaaacucauaccuaccaaaugaauuuggcugcucaaaauuggaacaguuaugacccaacagaagaaaucccagccccccuaggaacuccagauuucgugggaaagauccaaggugugcucacccaaaccacgaagggaaauggcucaacccgugcccacaaagcuacaguguacacugggaccgucgaguucacuccaaaacuggguagaauccaacuuuucacugacacagacaacgaucuugaagcuaaccaaaacacaaaguucaccccagucggugucauccaggauggugaccaccaaaaugaaccccaacaauggguacucccaaguuacucagguagaaauaaucacaaugugcaccuggcccccgcuguagcccccacuuuuccgggcgagcaacuucucuucuucagauccacuaugcccggaugcagcggguaccccaacaugaauuuggacugucugcuuccccaggaaugggugcaauauuucuaucaagaggcagccccagcacaaucugauguggcuuugcuaagauuugugaauccagauacagguaggguuuuguuugagugcaagcuucauaaaucagguuaugucacaguggcucacaccggccaccaugauuugguuauccccccuaaugguuauuucagauuugauuccugggucagccccuucuacacacuugcccccaugggaaauggaacggggcguagacgugcauuauaa

SEQ ID NO: 4612 - RNA, 1644 nt, Artificial Sequence
  capsid_protein_VP1__Norovirus__AHI59154
augaagauggcgucgaaugacgcugcuccaucgaaugauggugcugccaaccucguaccagaggccaacaaugagguuauggcacuugaaccgguggugggagccucaaucgcagcuccugucgucggccaacaaaacauaauugaccccuggauuagagaaaauuuuguccaagcaccacagggcgaguucaccguuucaccgaggaacucgcccggugagaugcuauuaaaucuugaauugggcccagagcucaacccuuaccuaagucaccugucccguauguauaauggguaugcugguggcaugcagguucaggugguccuagcugggaaugcguucacagcugggaaaaucaucuuugccgccguaccaccacauuuucccguagaaaacaucagugcagcucaaauaacuaugugcccccauguaauuguugaugugagacaacuugaaccaguacuucugccccuuccugacauaaggaauagguucuuucauuacaaccaggagaacaccccccggaugagacuuguggcuaugcuuuauaccccccugagggccaacucuggugaagauguguuuacuguuucuugcagggucuugacccguccugccccugauuuugaauuuacuuucuugguaccaccaacuguugagucaaagacuaaaccuuucacacugcccauauuaacucuuggugagcuaucuaauuccagauucccagccccaauagauauguuguacacugacccaaaugagggaauugugguccaaccacaaaaugguaggugcacucuugauggcacucugcaaggcaccacacaacugguccccacccaaauuugugcuuucaggggcacacuaauuggccaaacaucaagaucuucagacucaaccgacucagccccucggagaagggaucacccacuccaugugcaauuaaagaaccuugauggcacgcaguacgacccgacugaugaagugccagcaguccuuggugccauugacuucaaggggacugucuuugggguggccagucagagagaugugucagggcaacaagugggagcgacucgagcucaugaagugcacaucaacacaaccgauccuagguacacaccaaaacugggauccauucucaugcacucagagucggacgacuuugugacuggacagccgguccguuucacacccauaggaaugggugacaacgacuggcaccagugggagcugccugacuacucuggacaccuaacccugaacaugaaccuugccccagcagucgcuccugcuuucccgggcgagaggauucuuuucuucaggucaauggucccgucugcugguggcuaugggucuggacaaauagauugccucaugccacaggaguggguucagcauuucuaccaggaagcugcaccaucccaaucugccguggcacuuauuagguaugucaauccugacacaggcagaaacaucuuugaggcuaaauugcacagggaagguuucaucaccguggcaaauucugguaacaacccuauuguuguccccccuaauggguacuuuagguuugaggcuugggugaaucaauuuuacacuuugacccccaugggaacuggucaggggcguaggaggaaucaauaa

SEQ ID NO: 4613 - RNA, 1623 nt, Artificial Sequence
  capsid_protein_VP1__Norovirus__AHI59157
augaagauggcgucgaaugacgccaacccaucugauggguccacagccaaccucgucccagaggucaacaaugagguuauggcuuuggagcccguaguuggugccgccauugcggcaccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaacaauuucuaccauuauaaucaaucaaaugaccccacuaucaaauugauagcaauguuguacacaccacuuagggcuaauaaugccggggacgaugucuucacaguuucuugucgaguucucacgagaccaucccccgauuuugacuucauauuuuuggugccacccacaguugaaucaagaacuaaaccauuuucugucccaguuuuaacuguugaggagaugaccaauucaagguuccccauuccuuuggaaaaguuguucacgggccccaguagugccuuuguuguucaaccacaaaauggcaggugcacgacugauggcgugcuccuagguacuacccaacuguccccugucaacaucugcaccuucagaggugaugucacccauauuacaggcagucguaacuacacaaugaauuuggccucccaaaauuggaacaguuacgauccaacagaagaaaucccagccccucuaggaacuccagauuucguggggaagauucaaggugugcucacccaaaccacaaggacagauggcucgacccgcggccacaaagcuacaguguacacugggagcgccgacuuuucuccaaaacugggcagaguucaauuugccacugacacagacaaugauuuugaaaccaaccaaaacacaaaguucaccccagucgguguuauacaggaugguggcaccacccaucgaaaugaaccccaacaaugggugcucccaaguuacucaggcagaaauacucauaaugugcaucuggcccccgcuguagcccccacuuucccaggcgagcagcuccucuucuucagaucuacuaugcccggaugcagcggguaccccaacauggauuuggacugucugcucccccaggaaugggugcaguauuucuaccaagaggcagccccagcacaaucugauguggcucuuuuaagguuugugaauccagacacagguaggguuuuguuugaguguaagcuccauaaaucaggcuauguuacaguggcucacacuggucaacaugauuugguuaucccccccaaugguuauuuuagauuugauuccugggucaaccaguucuacacacuugcccccaugggaaaugggacggggcguagacgugcauuauaa

SEQ ID NO: 4614 - RNA, 1629 nt, Artificial Sequence
  capsid_protein_VP1__Norovirus__AHI59159
augaagauggcgucgaaugacgccgcuccaucuacugauggugcagccggccucgugccagaaaguaacagugaggucauggcucuugaacccguggcuggugccgccuuggcagccccggucaccggucaaacaaauauuauagacccuuggauuagagcaaauuuuguccaggcccccaauggcgaauuuacagucucuccccguaaugccccuggugaagugcuacuaaaucuagaguuggguccagaauuaaauccuuaucuggcacauuuagcaagaauguacaacggguaugccggugggauggaggugcaggucauguuagcugggaacgcguucacagccggcaaguuggucuucgccgccgugccaccucacuucccgguugaaaaccuuagcccacagcaaauuaccauguucccucaugugauuauagauguaaggaccuuggaaccuguuuuauuaccacucccugauguuaggaauaauuucuuccacuauaaucagaaagaugauccuaaaaugagaauuguggcuaugcuuuauaccccccuuaggucuaaugguucaggugaugauguguucacaguuuccugcaggguguugacuagacccuccccugauuuugacuucacauaucuggugccaccaacaguggaaucuaaaacaaaaccauucacccucccaauccucacacuuggggaacuuuccaauucuagguucccaguguccauagaccagauguacaccagcccuaaugaaguuauaucagugcagugucaaaaugguaggugcacauuggacggggagcuucaggggacaacacaacuccaagucaguggcauuugugcuuucaagggggaagugaccgcccacuugcaugacaaugaucaccuauacaaugucaccaucacaaacuugaauggguccccuuuugaccccuccgaggacguuccugccccucugggcgugccugacuuccagggaagggucuuuggugucaucucccaaagagacaaacacaauagcccugggcauaaugaaccagcaaacaggggacacgacgcuguggucccuacuuacacagcacaguacacuccaaaauugggucagguucaaauuggcacauggcagaccgacgaucuuacagucaaccaaccagucaaauucaccccaguuggacucaaugacacugaacauuuuaaucaaugggugguccccagauacgcuggugcccuaaaccucaacacaaaccuugccccuucuguugcuccaguauuuccaggggagcgccugcuuuucuucagaucauacguuccccucaagggugguuauggaaauccagccauugauugccuauuaccacaagagugggugcaacacuucuaucaggaggcugccccaucaaugagugagguggcccuugucagguacauuaacccggauacuggucgggcacuguuugaggccaagcuccacagagcugguuucaugacagucucgagcaacaccagugccccggugguugugccugccaauggguacuucagauuugacucuuggguuaaucaauucuauucucucgcccccaugggaacuggaaaugggcguagaaggguucaauaa

SEQ ID NO: 4615 - RNA, 1623 nt, Artificial Sequence
  capsid_protein_VP1__Norovirus__AHK24788
augaggaugagugauggcgcagcgccaaaagccaacggcucugaagccagcggccaggaucuuguuccuaccgccguugaacaggccguccccauucagcccguggcuggugcgucucuugccgcccccgccgccgggcaaauuaaccaaauugaccccuggaucuuccaaaauuuuguccaaugcccccuuggugaguuuuccauuucaccucgaaacaccccaggugaaauauuguuugauuuggcccuugggccagggcucaaccccuaccuugcccaccucucagccauguacaccggcuggguugggaauauggagguucagcugguccucgccggcaaugccuuuacugcuggcaaggugguuguugcccuuguaccacccuacuuucccaaagggucacucaccgcugcccagaucacaugcuucccacauguuaugugugaugugcgcacuuuggaacccauucaacucccucuucuugacgugcgucgaguucuuuggcaugcuacccaggaucaggaggaaucuaugcgccugguuugcaugcuguauacaccacuccgcacgaacagcccgggugaugagucuuuuguggucucuggccgccuucuuucuaagccggcagcugauuucaauuuuguauaccugaccccccccauugagagaacuaucuaccggauggucgacuugcccguguuacagccgcggcugugcacgcaugcucguuggccagcaccgguuuauggucucuugguggaucccucccucccguccaauccucaauggcagaauggaagagugcauguugauggaacccuucuuggcacaacaccugucucuggguccugggucuccugcuuugcagcugaggccgccuacgaguuccaguccgggacuggugagguggcgacuuucacccugauugagcaggauggauccgcuuauguuccuggugacagagcggcccccuuggguuacccugauuucucuggacagcuagagauugaggugcagacugagaccaccaaggcaggugauaagcugaaagugaccacuuuugagaugauccuuggucccaccaccaacguggaccaggcgcccuaccagggcaggguguacgccagcuugacggcugcagccucccucgaccugguggauggcaggguuagggcugucccgcguuccauuuaugguuuccaggaucagaucccugaguauaaugauggucuucuuguuccccuugcccccccuguuggcccuuuccuccccggugaguugcucuugagguuccggaccuacaugcgccagaucgacagcgcugacgcugcagcggaggccauugacugcgcccucccacaggaguucaucucgugguucgcgagcaacgcguucacggugcagucggaggcucugcuccuuagguauaggaacacccugacugggcaguugcuguuugaguguaagcucuacagcgaaggcuacaucgcccuguccuauucgggcucaggaccgcucaccuuuccgacugauggcuucuuugagguugucagcugggucccccgucuuuaucaauuggccucugugggaagcuuggcaacaggccgaacacucaaguaa

SEQ ID NO: 4616 - RNA, 1623 nt, Artificial Sequence
  capsid_protein_VP1__Norovirus__AHX22018
augaagauggcgucgagugacgccaacccaucugauggguccgcagccaaccucgucccagaggucaacaaugagguuauggcucuggagcccguuguuggugccgccaucgcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuuaagccccagccaggucacuauguucccccauauaguaguagauguuaggcaacuagaaccuguguugauccccuuacccgauguuaggaauaauuucuaucauuacaaucaaucaaaugaccccaccauuaaguugauagcaauguuguauacaccacuuagggcuaauaaugcuggggacgaugucuucacaguuucuugccgaguucucacaagaccaucccccgauuuugauuucauauuuuuagugccacccacaguugagucaagaacuaaaccauucucugucccaguuuuaacuguugaggagaugaccaauucaagauuccccauuccucuggaaaaguuguucacgggucccagcggugccuuuguuguucaaccacaaaacggcaggugcacgacugauggcgugcucuuaggcaccacccaacugucuccugucaacaucugcaccuucagaggggaugucacccauaucacaggcagucgcaauuacacaaugaauuuggcuucucaaaauuggaacaauuaugacccaacagaggaaaucccagccccucuaggaacuccagacuuuguggggaagauucaaggcaugcucacccaaaccacaaggacagauggcucaacacgcggccacaaggcuacaguguacacugggagcgccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggucaacaugauuugguuaucccccccaaugguuauuuuagguuugauucuugggucaaccaguucuacacgcuugcccccaugggaaauggaacggggcguagacguguaguauaa

SEQ ID NO: 4617 - RNA, 1623 nt, Artificial Sequence
  capsid_protein_VP1__Norovirus__AHX22021
augaagauggcgucgagugacgccaacccaucugauggguccacagccaaccucgucccagaggucaacaaugagguuauggcuuuggagcccguaguuggugcugcuauugcggcaccuguagcgggccagcaaaauguaauugaccccuggauuagaaacaauuuuguacaagccccugguggagaguuuacaguauccccuagaaacgcuccaggugagauacuauggagcgcgcccuuaggcccugauuugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucagucaaaugaccccaccaucaaauugauagcaauguuguacacaccacuuagggcuaacaaugccggggacgacgucuucacaguuucuugucgaguccucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgauccaacagaagaaaucccagccccccuaggaacuccagauuucguggggaagauucaaggugugcucacccaaaccacaaggacagauggcucgacccgcggccacaaagcuacaguguacacugggagcgccgacuuuucuccaaaacuggguaggguucaauuuaccacugacacagacaaugauuuuguaacuaaccaaaacacgaaguucaccccagucgguguuauccaggaugguaguacuaccccccgaaacgaaccccaacaaugggugcucccaaguuacucaggcagaaacacucauaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaggcagccccagcacaaucugauguggcgcuguuaagauuugugaauccagacacagguaggguuuuguuugaguguaagcuucauaaaucaggcuauguuacaguggcucacacuggccaacaugaucuaguuaucccccccaaugguuauuuuagauuugauuccugggucaaccaguucuacacacuugcccccaugggaaaugggacggggcguagacgugcauuauaa

SEQ ID NO: 4618 - RNA, 1623 nt, Artificial Sequence
  capsid_protein_VP1__Norovirus__AHX22025
augaagauggcgucgagugacgccaacccaucugauggguccacagccaaccucgucccagaggucaacaaugagguuauggcuuuggagcccgugguuggugccgcaauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagacaauccucgcggggaacgcguucaccgccgggaaaaucauauuugcagcagucccaccaaauuucccaacugaagguuugagccccagccagguuacuauguucccccacauaauaguagauguuaggcaauuggaaccuguguugauucccuuacccgauguuagaaauaauuucuaccauuacaaccaaacaaaugaccccaccaucaaauugauagcaauguuguacacaccacuuagggcuaauaaugccggggacgaugucuucacagucucuugucgaguucucacaagaccaucccccgauuuugauuucauauuuuuggugccacccacaguugaaucaagaacuaaaccauucucugucccgguuuugacuguugaggagaugaccaauucaagguuccccauuccuuuggagaaauuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgauccaacagaagaaaucccagccccucuaggaacuccagauuucguggggaagauucaaggugugcucacccaaaccacaaggacagauggcucgacccgcggccacaaagcuacaguguacacugggagcgccgacuuuucuccaaaacuggguagaguucaauuugccacugauacagacaaugauuuugaaacuaaccaaaauacaaaguucaccccagucgguguuauccaggauggugguacuacccaccgaaaugaaccccaacaaugggugcucccaaguuacucaggcagaaacacucauaaugugcaccuggcccccgcuguagcccccacuuucccgggcgagcagcuccucuuuuucagaucuacuaugcccggaugcagcggguaccccaacauggauuuggacugucugcucccccaggaaugggugcaguauuuuuaccaggaggcagccccagcacaaucugauguggcucuguuaagauuugugaauccagauacagguaggguccuguuugaguguaaacuucauaaaucaggcuauguuacaguggcucacacuggccaacaugauuugguuaucccccccaaugguuauuuuagauuugacuccugggucaaccaguucuauacacuugcccccaugggaaaugggacggggcguagacgugcauuauaa

SEQ ID NO: 4619 - RNA, 1623 nt, Artificial Sequence
  capsid_protein_VP1__Norovirus__AHX22028
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaacaauuucuaucauuauaaucaaucaaaugaccccaccauuaaguugauagcaauguuguauacaccacuuagggcuaauaaugcuggggaugaugucuuuacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguucaaccacaaaacggcaggugcacgacugauggcgugcuccuaggcaccacccaacugucuccugucaacaucugcaccuucagaggagaugucacccauaucacugguagucguaacuacacaaugaauuuggcuucucaaaauuggaacaauuaugacccaacagaagaaaucccagccccucuaggaacuccagauuucguggggaagauucaaggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccagucggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucaggcuauguuacaguggcucauacuggccaacaugauuugguuaucccccccaaugguuauuuuagguuugauuccugggucaaccaguucuacacgcuugcccccaugggaaauggaacggggcguagacgugugguauaa

SEQ ID NO: 4620 - RNA, 1623 nt, Artificial Sequence
  capsid_protein_VP1__Norovirus__AHX22032
augaagauggcgucgagugacgccaacccaucugauggguccacagccaaccucgucccagaggucaacaaugagguuauggcuuuggagcccgugguuggugccgcaauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaccccuaccuuucccauuuggccagaauguacaaugguuaugcaggugguuuugaagugcagacaauccucgcggggaacgcguucaccgccgggaaaaucauauuugcagcagucccaccaaauuucccaacugaagguuugagccccagccagguuacuauguucccccacauaauaguagauguuaggcaauuggaaccuguguugauucccuuacccgauguuagaaauaauuucuaccauuacaaucaaacaaaugaccccaccaucaaauugauagcaauguuguacacaccacuuagggccaauaaugccggggacgaugucuucacaguuucuugucgaguucucacaagaccaucccccgauuuugauuucauauuuuuggugccacccacaguugaaucaagaacuaaaccauucucugucccgguuuuaacuguugaggagaugaccaauucaagguuccccauuccuuuggagaaauuauucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgauccaacagaagaaaucccagccccucuaggaacuccagauuucguggggaagauucaaggugugcucacccaaaccacaaggacagauggcucgacccgcggccacaaagcuacaguguacacugggagcgccgacuuuucuccaaaacugggcagaguucaauuugccacugauacagacaaugauuuugaaacuaaccaaaauacaaaguucaccccagucgguguuauccaggauggugguaccacccaccaaaaugaaccccaacaauggguacucccaaguuacucaggcagagacacucacaaugugcaccuggcccccgcuguagcucccacuuucccgggcgagcagcuccucuucuucagaucuacuaugcccggaugcagcggguaccccaacauggauuuggacugucugcucccccaggaaugggugcaguauuuuuaccaggaggcagccccagcacaaucugauguggcucuguuaagauuugugaauccagauacagguagggucuuguuugaguguaaacuucauaaaucaggcuauguuacaguggcucacacuggccaacaugauuugguuaucccccccaaugguuauuuuagauuugacuccugggucaaccaguucuacacacuugcccccaugggaaaugggacggggcguagacgugcacuauaa

SEQ ID NO: 4621 - RNA, 1623 nt, Artificial Sequence
  capsid_protein_VP1__Norovirus__AHX22038
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuuaagccccagccaggucacuauguucccccauauaguaguagauguuaggcaacuagaaccuguguugauucccuuacccgauguuaggaauaauuucuaucauuacaaccaaucaaaugaccccaccauuaaguugauagcaauguuguauacaccacuuagggcuaauaaugcuggggacgaugucuucacaguuucuugccgaguucucacaagaccaucccccgauuuugauuucauauuuuuagugccacccacaguugagucaagaacuaaaccauucucugucccaguuuuaacuguugaggagaugaccaauucaagauuccccauucccuuggagaaguuguucacgggucccagcagugccuuuguuguucaaccacaaaacggcaggugcacgacugauggcgugcuccuaggcaccacccaacugucuccugucaacaucugcaccuucagaggggaugucacccauaucacaggcagucgcaacuacacaaugaauuuggcuucucuaaauuggaacaauuaugacccaacagaagaaaucccagccccucuaggaacuccagacuuuguggggaagauucaaggcaugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaacccagacacagguaggguuuuguuugaguguaagcuucauaaaucaggcuauguuacaguggcucacacuggccaacaugauuugguuaucccccccaaugguuauuuuagguuugauucuugggucaaccaguucuacacgcuugcccccaugggaaauggaacggggcguagacguguaguauaa

SEQ ID NO: 4622 - RNA, 1623 nt, Artificial Sequence
  capsid_protein_VP1__Norovirus__AHX22041
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuauaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguucaaccacaaaacggcaggugcacgacugauggcgugcuccuaggcaccacccaacugucuccugucaacaucugcaccuucagaggagaugucacccauaucacugguagucauaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuuugcuccaaaacuggguagaguucaauuugcaacugacacagaccaugauuuugaagcuaaccaaaacacaaaguucaccccagucggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucaggcuauguuacaguggcucauacuggccaacaugauuugguuaucccccccaaugguuauuuuagguuugauuccugggucaaccaguucuacacgcuugcccccaugggaaauggaacggggcguagacguguaguauaa

SEQ ID NO: 4623 - RNA, 1623 nt, Artificial Sequence
  capsid_protein_VP1__Norovirus__AHX22047
augaagauggcgucgagugacgccaacccaucugauggguccacagccaaccucgucccagaggucaacaaugagguuauggcuuuggagcccguaguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuuaggcccugaucugaaucccuaccuuucccauuuggccagaauguacaaugguuaugcaggugguuuugaagugcagguaauccucgcggggaaugcguucaccgcggggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaagugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaauggcaggugcacgacugauggcgugcuccuagguacuacccaacuguccccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccagaccacaaggacaaauggcucgacccgcggccacaaagcuacaguguacacugggagcgccgacuuuucuccaaaacuggguagaguucaauuugccacugacacagacaaugauuuugaaacuaaucaaaacacaaaguucaccccagucgguguuauccaggaugguaguaccaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuucagauuugauuccugggucaaccaguucuacacacuugcccccaugggaaaugggacggggcguagacgugcauuauaa

SEQ ID NO: 4624 - RNA, 1623 nt, Artificial Sequence
  capsid_protein_VP1__Norovirus__AHX22050
augaagauggcgucgagugacgccaacccaucugauggguccacagccaaccucgucccagaggucaacaaugagguuauggcuuuggagcccguaguuggugcugcuauugcggcaccuguagcgggccagcaaaauguaauugaccccuggauuagaaacaauuuuguacaagccccugguggagaguuuacaguauccccuagaaacgcuccaggugagauacuauggagcgcgcccuuaggcccugauuugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucagucaaaugaccccaccaucaaauugauagcaauguuguacacaccacuuagggcuaacaaugccggggacgacgucuucacaguuucuugucgaguccucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgauccaacagaagaaaucccagccccccuaggaacuccagauuucguggggaagauucaaggugugcucacccaaaccacaaggacagauggcucgacccgcggccacaaagcuacaguguacacugggagcgccgacuuuucuccaaaacuggguaggguucaauuugccacugacacagacaaugauuuuguaacuaaccaaaacacgaaguucaccccagucgguguuauccaggaugguaguacuaccccccgaaacgaaccccaacaaugggugcucccaaguuacucaggcagaaacacucauaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaggcagccccagcacaaucugauguggcgcuguuaagauuugugaauccagacacagguaggguuuuguuugaguguaagcuucauaaaucaggcuauguuacaguggcucacacuggccaacaugaucuaguuaucccccccaaugguuauuuuagauuugauuccugggucaaccaguucuacacacuugcccccaugggaaaugggacggggcguagacgugcauuauaa

SEQ ID NO: 4625 - RNA, 1623 nt, Artificial Sequence
  capsid_protein_VP1__Norovirus__AHX22054
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuugugcaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaaugcguucaccgccgggaaaaucauauuugcagcagucccacccaauuucccaacugaagguuugagccccagccaagucacuauguucccccacauaauaguagauguuaggcaauuggaaccuguguugauccccuuacccgauguuaggaauaauuucuaucauuauaaucagucaaaugacuccaccaucaaauugauagcaauguuguacacaccacuuagggcuaacaaugccggggacgaugucuucacaguuucuugucgaguccucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggugaugucauccacauuucaggcagucguaacuacacaaugaauuuggccucccaaaauuggaacaguuacgauccaacagaagaaaucccagccccccuaggaacuccagauuucguggggaagauucaaggugugcucacccaaaccacaaggacagauggcucgacccgcggccacaaagcuacaguguacacugggagcgccgacuuuucuccaaaacuggguaggguucaauuugccacugacacagacaaugauuuuguaacuaaucaaaacacaaaguucaccccagucgguguuauccaggaugguagcacuaccccccgaaaugaaccccaacaaugggugcucccaaguuacucaggcagaaacacucauaaugugcaccuggcccccgcuguagcccccacuuucccgggcgagcagcuccucuucuucagauccaccaugcccggaugcagcggguaccccaacauggauuuggacugucugcucccccaggaaugggugcaguauuucuaccaggaggcagcuccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacgugcauuauaa

SEQ ID NO: 4626 - RNA, 1647 nt, Artificial Sequence
  capsid_protein_VP1__Norovirus__AIA96988
augaagauggcgucgaaugacgcugcuccaucuaaugauggugccgccggccucguaccagagaucaguaaugaggcaauggcgcuagauccaguggcgggugcagcgauagcagcaccccuuacuggccagcaaaacauaauagaucccuggauuaugaauaauuuugugcaagcaccugguggugaguuuacagugucacccaggaacuccccuggugaaauacuucuaaauuuagaauuaggcccagaaauaaaucccuaucuggcgcaucuugcuaggauguacaaugguuaugcagguggguuugaggugcaggugguccuggcuggaaaugcguuuacagcaggaaaagugaucuuugcagcuauaccccccaauuucccaacugacaauuugagugcagcgcagauuacaaugugcccucauguaauuguggaugucaggcaguuggaaccaaucaaccucccgaugccugauguccgcaacaauuucuuucauuacaaucaagguucugauucaagguuacgcuuaauugcaauguuguacacaccccuuagggcaaauaauucuggagaugauguuuucacugugucauguaggguauugacuaggcccaguccugauuucucauucaacuuccucgucccgcccacuguggaaucaaagacaaaaccuuuuacccucccaauuuugacuaucucugagaugucuaauucuagauuuccagugccaauugacucucugcacaccaguccaacugauaacauuguuguccagugccaaaaugggcgcgucacccuugauggugagcuaaugggcaccacccaacucuugccgagucagauaugugcuuuuaggggugugcucaccagaucaacaagcagggccagugaccacgcugacacagcaacccccaggcucuucaauuacuacuggcacauacaacuagacaaccuaaaugggaccccguaugauccugcagaggacauaccagcuccucuggggacaccagacuuucggggcaaagucuuuggcguggccagccagagaaacccugacagcacaacaagggcacaugaggcaaaaguggacacaacaucuggccgcuucaccccaaaauuaggcucccuagaaauguccacugaaucugaugacuuugaucaaaaucaaccaacaagauucaccccaguuggcauuggaguugacaaugaggcagacuuucaacaauggaccuuaccugacuauuccggucaguucacccacaacaugaaucuggccccagcugucgcucccaauuuucccggugaacagcuucuuuucuuccgcucacagcugccauccucuggcgggcgguccaaugguauucuagacugccuggucccccaggaauggguccaacauuucuaucaggaauccgccccugcccagacgcagguggcucuggucagguaugucaauccugauacugguaggguguuauuugaggcuaagcugcauaagcuaggcuacaugaccauagcuaagaguggugauucuccaauaacuguacccccaaauggauacuuuagguuugaaucuugggugaaccccuuuuacacacuagcccccaugggaacugggaaugggcguagaaggauucaauaa

SEQ ID NO: 4627 - RNA, 1623 nt, Artificial Sequence
  capsid_protein_VP1__Norovirus__AII02569
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguaucuccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaacaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugcuuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcuaggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuuuauaaaucaggcuaugucacaguggcucacaccggucagcaugauuuggucaucccccccaauggcuauuuuagguuugauuccuggguuaaucaguucuacacgcucgcccccaugggaaacggaacggggcguaggcgcgccuuauaa

SEQ ID NO: 4628 - RNA, 1623 nt, Artificial Sequence; identical to SEQ ID NO: 4440
  capsid_protein_VP1__Norovirus__AII02572

SEQ ID NO: 4629 - RNA, 1623 nt, Artificial Sequence; identical to SEQ ID NO: 4446
  capsid_protein_VP1__Norovirus__AII02575

SEQ ID NO: 4630 - RNA, 1623 nt, Artificial Sequence; identical to SEQ ID NO: 4468
  capsid_protein_VP1__Norovirus__AII02578

SEQ ID NO: 4631 - RNA, 1647 nt, Artificial Sequence
  capsid_protein_VP1__Norovirus__AII02581
augaagauggcgucgaaugacgccgcuccaucuaaugauggugccgccggccucgucccagagaucaacagugaggcaauggcgcuagagccaguggcgggugcagcgauagcagcaccccucacuggucagcaaaauauaauugaucccuggauuaugaauaauuuugugcaagcaccugguggugaguucacaguauccccuagaaauuccccuggugaaguucuucucaauuuggaauuggguccagaaauaaaucccuacuuggcccaucuugcuagaauguauaaugguuaugcagguggauuugaagugcaggugcuccuagcuggaaaugcguuuacagcaggaaagauaaucuuugcagcuauucccccuaauuuuccaauugauaaucuaagugcagcacagaucacaauguguccacaugugauuguggauguuagacagcuggaaccagucaaccucccgaugccugacguucgcaacaacuuuuuccauuacaaucaggggucugauucgagauugcgccuaauugcaaugcuauauacaccucuuagggcaaauaacucuggggaugauguuuucacugugucuugcagagugcuaacuagaccuaguccugacuucucauuuaauuuccuugugccacccacuguggagucaaagacaaaacccuuuucccuccccauucugacuaucucugaaauguccaauucuagguucccaguaccaauugauucucugcacaccagcccuacugagaacauuguuguccagugccagaauggacgcgucacccuugauggugaguugaugggcaccacccaacuuuuaccuagccaaaucugugcuuucaggggcaugcucaccagaucaacaagcagggccagugaccaggccgauacagcaaccccuagauuguuuaauuauuauuggcauauacaauuggauaaccuaaauggaacuccuuaugacccugcagaagauauaccaggcccccuagggacaccagauuuccggggcaaagucuuuggcguggccagccagagaaauccugaugccacgacuagggcacaugaagcaaagauagacacaacaucuggccgcuucaccccaaaauuaggcucacuagagauuuccacugagucuggagauuuugaucaaaaccaaccaacaagauucaccccaguuggcauugggguugaccaugaggcagauuuucaacaauggacucuucccgacuaugcuggccaguucacccacaacaugaacuuagccccagcuguugcucccaacuucccuggugagcagcuccuuuucuuccgcucacaguugccaucuucuggugggcgguccaacgggauucuagacugccuggucccccaagaauggguacagcacuucuaccaagaaucagcccccucccaaacucaaguggcccugguuagguaugucaacccugacacugguagaguguuauuugaggccaagcugcacaaauuagguuucaugacuauagccaagaguggugacucuccaauaacuguccccccaaauggauacuuuagguuugaaucuugggugaaccccuuuuauacacuugcccccaugggaacugggaaugggcguagaaggauucaauaa

SEQ ID NO: 4632 - RNA, 1623 nt, Artificial Sequence
  capsid_protein_VP1__Norovirus__AII02584
augaagauggcgucgaaugacgccaacccaucugauggguccgcagccaaccucgucccagaggucaacaaugagguuauggcuuuggaacccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaacuuuccaacugaaggccugagucccagccaggucacuauguucccccacauaauaguagauguuaggcaauuggaaccuguguugauccccuuaccugauguuaggaauaacuucuaucacuauaaccagacaaaugauucuaccauuaaacugauagcaaugcuguauacaccacuuagggccaauaaugcuggggaagaugucuucacagucucuugucgaguccucacgaggccauccccugauuuugauuuuauauuuuuggugccacccacaguugagucaagaacuaaaccauuuacugucccaaucuuaaccguugaagaaaugaccaauucaagauuccccauuccuuuggaaaaacuguucacgggucccagcagcgccuuuguuguccaaccacaaaauggcagaugcacgacugauggcgugcucuuaggcaccacccaacugucuccugucaacaucugcaccuucagaggggaugucacccacauugcagguucucguaauuacacaaugaauuuggcaucucuaaacuggaacaauuaugacccaacagaagaaauuccagccccucuaggaacuccagauuucgugggaaagauccaaggugugcucacucaaaccacaaaaggagauggcucgacccguggccauaaagccacaguuuacacugggagugcccccuucacuccaaagcugggcaguguucaauucagcaccgacacagaaaaugauuuugaaacucaccaaaacacaaaauucaccccagucggcgucauccaggaugguggcaccacccaccgaaaugaaccccaacaaugggugcucccaaguuauucagguagaaauguccauaauguacaccuagccccugcuguagcccccacuuuuccgggugaacaacuucucuucuucagguccacuaugcccggaugcagcggguaucccaacauggauuuggauugccuacucccccaggagugggugcagcacuucuaccaagaggcagcuccagcacaaucugauguggcucuauuaagauuuguaaauccagacacggguaggguccuguuugagugcaaacuucauaaaucaggcuaugucacaguggcccacaccggccagcaugauuuggucaucccccccaauggcuauuuuagguuugauuccuggguuaaucaauucuacacacuugcccccaugggaaacggaacggggcguagacgcgcuuuauaa

SEQ ID NO: 4633 - RNA, 1623 nt, Artificial Sequence; identical to SEQ ID NO: 4445
  capsid_protein_VP1__Norovirus__AII02590

SEQ ID NO: 4634 - RNA, 1623 nt, Artificial Sequence
  capsid_protein_VP1__Norovirus__AII02593
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauucccuuggaaaaguuguucacgggccccaguagugccuuuguuguucaaccacaaaacggcaggugcacgacugauggcgugcuccuagguacuacccaacugucucccgucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucacaaugugcaccuggcccccgcuguagcccccacuuucccgggcgagcagcuccucuucuucagaucuacuaugcccggaugcagcggguaccccaacauggacuuggacugucugcucccccaggaaugggugcaguauuucuaccaggaggcagccccagcacaaucugauguggcucugcuaagauuugugaacccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 4635 - RNA, 1623 nt, Artificial Sequence; identical to SEQ ID NO: 4492
  capsid_protein_VP1__Norovirus__AII02596

SEQ ID NO: 4636 - RNA, 1623 nt, Artificial Sequence
  capsid_protein_VP1__Norovirus__AII02599
augaagauggcgucgaaugacgccaacccaucugauggguccgcagccaaccucgucccagaggucagcaaugagguuauggcuuuggaacccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcagaugcacgacugauggcgugcucuuaggcaccacccaacugucuccugucaacaucugcaccuucagaggggauaucacccacauugcagguucucgugauuacacaaugaauuuggcaucucuaaauuggaacaauuaugacccaacagaagaaauuccagccccucugggaacuccagauuucgugggaaagauccaaggugugcucacucaaaccacaaaaagagauggcucgacccguggccauaaagcuacaguuuacacugggagugcccccuuuacuccaaagcugggcaguguucgauucaguacugacacagaaaaugauuuugaaacucaccaaaacacaaaauucaccccagucggugucauccaggaugguagcaccacccaccgaaaugaaccccaacaaugggugcucccaaguuauucagguagagauguucauaauguacaccuagccccugcuguagcccccacuuuuccgggugaacaacuucuuuucuucagguccaccaugcccggaugcagcggguaucccaacauggacuuggauugccuacucccccaggagugggugcagcacuucuaccaagaggcagcuccagcacaaucugauguggcucuacugagauuugugaauccagacacggguaggguccuguuugagugcaaacuucauaaaucagguuaugucacaguggcucacaccggucagcaugauuuggucaucccccccaauggcuauuuuagguuugauucuuggguuaaccaauucuacacacuugcccccaugggaaacggaacggggcguaggcgcgcuuuauga

SEQ ID NO: 4637 - RNA, 1623 nt, Artificial Sequence
  capsid_protein_VP1__Norovirus__AII02602
augaagauggcgucgagugacgccaacccaucugauggguccacagccaaccuugucccagaggucaauaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaauccuuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgaugucaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggacgucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggacuuggacugucugcucccccaggaaugggugcaauauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 4638 - RNA, 1608 nt, Artificial Sequence
  capsid_protein_VP1__Norovirus__AII02605
augaagauggcgucgaaugacgccgcuccaucuaaugauggugcagccggucucguaccagaggucaacaaugagaccauggcacuugaaccgguggcuggggcuucaauagccgccccacucaccggccaaaauaauguuauagaccccuggauuagauuaaacuuugugcaagcucccaauggagaguuuacaguuucaccccgcaauucgccuggggaaguccuacuaaacuuggaauuaggcccugaacuaaauccauauuuggcacaccuuuccagaauguacaaugguuaugcagguggaguugaggugcaaguacuacuggcugggaacgcguucacggcuggaaaacugguauucgccgcaguucccccucauuuuccauuagaaaacauaagcccuggccaaauaaccauguucccucauguaauuauugauguuaggacuuuagaaccaguccuauugccucuuccagauguuaggaacaauuucuuucacuacaaucagcaaaacgaaccgaggaugaggcuuguggcaaugcucuauaccccccuuaggucuaaugguucuggugaugauguauuuacugucuccuguagagugcuuacucgacccucuccugauuuugauuucaauuauuugguacccccuacaguugaaucuaaaacuaaacccuucacacuccccaucuugaccauaggggaguuaaccaauuccagauucccugugccuauagaugaacucuacacuagccccaaugagaguuuggugguacaaccccagaacgggagaugcgcgcuggauggggaguugcaggguacuacucagcuccuccccacggcgaucugcucguucaggggucggauuaaucagaaagugaguggagagaaccauguuuggaauaugcaagucaccaacauuaacggaaccccuuuugauccaacagaggauguuccagcuccucuagguacaccagacuuuucuggcaagcucuuuggcguccuaagccagagggaccaugauaaugccuguaggagccaugaugcagugauugcaacuaauucugcuaaauuuaccccaaaauugggcgcuauacaaauuggcacaugggaacaagaugauguacacaucaaccaacccaccaaauuuacuccaguuggcuuguuugaaagugaagguuuuaaucaguggacacucccuaauuauucuggagccuuaacacucaacaugggguuggcccccccuguggcccccacauuuccuggcgagcaaauucuuuucuucagaucccacauuccucuuaaaggagguguggcagacccaguuauugauugucucuugccccaagaguggauccaacaccuuuaucaggagucagccccuucacaaacagauguagcacugaucagauucacaaauccagacacagggcguguccuauuugaagcaaaauugcacaggaguggcuacaucacaguggccaacacugguagcagaccaauuguggugccagcuaaugguuacuucagguuugacucuuggguuaaucaguuuuauucucucgcccccaugggaacugggaaugggcgcagaagggugcaguaa

SEQ ID NO: 4639 - RNA, 1647 nt, Artificial Sequence
  capsid_protein_VP1__Norovirus__AII02608
augaagauggcgucgaaugacgccgcuccaucuaaugauggugccgccggccucgucccagagaucaacagugaggcaauggcgcuagagccaguggcgggugcagcgauagcagcaccccucacuggucagcaaaauauaauugaucccuggauuaugaauaauuuugugcaagcaccugguggugaguucacaguauccccuagaaauuccccuggugaaguucuucucaauuuggaauuggguccagaaauaaaucccuacuuggcccaucuugcuagaauguauaaugguuaugcagguggauuugaagugcaggugguccuagcuggaaaugcguuuacagcaggaaagauaaucuuugcagcuauucccccuaauuuuccaauugauaaucuaagugcagcacagaucacaauguguccacaugugauuguggauguuagacagcuggaaccagucaaccucccgaugccugacguucgcaauaacuuuuuccauuacaaucaggggucugauucgagauugcgccuaauugcaaugcuauauacaccucuuagggcaaauaacucuggggaugauguuuucacugugucuugcagagugcuaacuagaccuaguccugacuucucauuuaauuuccuugugccacccacuguggagucaaagacaaaacccuuuucccuccccauucugacuaucucugaaauguccaauucuagguucccaguaccaauugauucccugcacaccagcccuacugagaacauuguuguccagugccagaauggacgcgucacccuugauggugaguugaugggcaccacccaacuuuuaccuagccaaaucugugcuuucaggggcaugcucaccagaucaacaagcagggccagugaccaggccgauacagcaaccccuagauuguuuaauuauuauuggcauauacaauuggauaaccuaaaugggacuccuuaugacccugcagaagauauaccaggcccccuagggacaccagauuuccggggcaaagucuuuggcguggccagccagagaaauccugaugccacgacuagggcacaugaagcaaagauagacacaacgucuggccgcuucaccccaaaauuaggcucacuagagauuuccacugagucuggagauuuugaucaaaaccaaccaacaagauucaccccaguuggcauugggguugaccaugaggcagaucuucaacaauggacucuucccgacuaugcuggccaguucacccacaacaugaacuuagccccagcuguugcucccaacuucccuggugagcagcuccuuuucuuccgcucacaguugccaucuucuggugggcgguccaacgggauucuagacugccuggucccccaagaauggguacagcacuucuaccaagaaucagcccccucccaaacucaaguggcccugguuagguaugucaacccugacacugguagaguguuauuugaggccaagcugcacaaauuagguuucaugacuauagccaagaguggugacucuccaauaacuguccccccaaauggauacuucagguuugaaucuugggugaaccccuuuuauacacuugcccccaugggaacugggaaugggcgcagaaggauucaauaa

SEQ ID NO: 4640 - RNA, 1623 nt, Artificial Sequence
  capsid_protein_VP1__Norovirus__AII02614
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucagacaaaugauucuaccauuaaauugauagcaaugcuguauacaccacuuagggccaauaaugcuggggaagaugucuuuacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguagcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuagauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4641 - RNA, 1653 nt, Artificial Sequence
  capsid_protein_VP1__Norovirus__AII02623
augaagauggcgucgaaugacgccacuccaucaaaugauggugcugccaaccucguaccagaggccaacaaugagguuauggcacuugaaccgguggugggagcuucaaucgcagcuccuguugucggucagcaaaauauaauugaccccuggauuagagaaaauuuuguccaagcaccacagggcgaguuuacuguuucaccaaggaauucgcccggugagaugcuucuuaaucuugaauugggcccagaacuuaaccccuauuugagucauuugucccgcauguacaauggguaugcugguggcaugcagguucaggugguccuagcugggaaugcguucacagcugggaagaucaucuuugccgcugugccaccacacuucccuguggauaauauuagugcagcccagauaacuauguguccucaugugauugucgaugugagacagcuugaaccagugcuucugccucuccccgauauaaggaacagguucuuccauuacaaucaggaaaacaccccccggaugagacucguggccaugcucuacacgccucuaagggcuaauucuggagaggacguguucacuguguccuguaggguucugacucgccccgcuccagauuuugaauuuacauuuuuaguuccaccaacuguugaaucaaaaacaaaacccuucacuuuaccuauucuaacccuuggugaguugucuaauucccguuuuccugcugccauagauaugcuuuauacugaucccaaugaaucaauaguuguucagccccaaaaugguagaugcacccuugauggcacauugcaaggcacaacacaauuaguuccaacacagauuugugccuuuagagguaccuugaucagccagaccgcgagagcggccgauucaacggauuucccccagagagcccguaaucacccguuacauguccaggucaagaaccuagauggcacacaguaugacccaacagaugacaucccugcaguccugggggcuauugauuucaaaggcacaguguucggaguggcaagucagagggacgucucuggaacacaagaacagggccauuaugccacccgggcccaugaagcacacauugacacaacugacccaaaguaugcaccuaaauuaggcacaauucucaucaaaucugaaucuacugauuucaacacaaaucagcccauuagguucacuccagugggcaugggugauaacaauuggagacagugggaacugccugacuauucugguaguuugacucuaaauaugaaccuugcccccgcuguuuccccauccuucccuggugaacgaauccuuuucuucaggucuauaguaccaucagcuggaggcuaugggucuggcuauauagacugucucauaccccaggaaugggugcaacacuucuaccaggaggcagcaccuucacaaucugccguugcacugguuagguaugucaaccccgacacugggcguaacaucuuugaggccaaauugcauagagaaggguuccucaccguggcuaauucuggaaauaauccuauugugguucccccuaaugguuauuuuagauuugaggcuuggguuaaucaauuuuacacacuugcccccaugggaucuggacaggggcguagaagggcucaguaa

SEQ ID NO: 4642 - RNA, 1623 nt, Artificial Sequence; identical to SEQ ID NO: 4485
  capsid_protein_VP1__Norovirus__AII02626

SEQ ID NO: 4643 - RNA, 1647 nt, Artificial Sequence
  capsid_protein_VP1__Norovirus__AII02629
augaagauggcgucgaaugacgccgcuccaucuaaugauggugccgccggccucgucccagagaucaacagugaggcaauggcgcuagagccaguggcgggugcagcgauagcagcaccccucacuggucagcaaaauauaauugaucccuggauuaugaauaauuuugugcaagcaccugguggugaguucacaguauccccuagaaauuccccuggugaaguucuucucaauuuggaauuggguccagaaauaaaucccuacuuggcccaucuugcuagaauguauaaugguuaugcagguggauuugaagugcaggugguccuagcuggaaaugcguuuacagcaggaaagauaaucuuugcagcuauucccccuaauuuuccaauugauaaucuaagugcagcacagaucacaaugugcccacaugugauuguggauguuagacagcuggaaccagucaaccucccgaugccugacguucgcaauaacuuuuuccauuacaaucaggggucugauucgagauugcgccuaauugcaaugcuguauacaccucuuagggcaaauaacucuggggaugauguuuucacugugucuugcagagugcuaacuagaccuaguccugacuucucauuuaauuuccuugugccacccacuguggagucaaagacaaaacccuuuucccuccccauucugacuaucucugaaauguccaauucuagguucccaguaccaauugauucucugcacaccaguccuacugagaacauuguuguccagugccagaacggacgcgucacccuugauggugaguugaugggcaccacucaacuuuuaccuagccaaaucugugcuuucaggggcaugcucaccagaucaacaagcagggccagugaccaggccgauacagcaaccccuagauuguuuaauuauuauuggcauauacaauuggauaaccuaaauggaacuccuuaugacccugcagaagauauaccaggcccccuagggacaccagauuuccggggcaaagucuuuggcguggccagccagagaaauccugaugccacgacuagggcacaugaagcaaagauagacacaacaucuggccgcuucacuccaaaauuaggcucacuagagauuuccacugagucuggagauuuugaucaaaaccaaccaacaagauucaccccaguuggcauugggguugaccaugaggcagauuuucaacaauggacucuucccgacuacgcuggccaguucacccacaacaugaacuuagccccagcuguugcccccaacuuccccggugagcagcuccuuuucuuucgcucacaguugccaucuucuggcgggcgguccaacgggauucuagacugccuggucccccaagaauggguacagcacuucuaucaagaaucagcccccucccaaacucaaguggcccugguuagguaugucaacccugacacugguagaguguuauuugaggccaagcugcacaaauuagguuucaugacuauagccaagaguggugacucuccaauaacuguccccccaaauggauacuucagguuugaaucuugggugaaccccuuuuauacacuugcccccaugggaacugggaaugggcguagaaggauucaauaa

SEQ ID NO: 4644 - RNA, 1623 nt, Artificial Sequence
  capsid_protein_VP1__Norovirus__AII02632
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuucguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcgggugauccucgcggggaacgcguucaccgccggaaaaauuauauuugcagcagucccaccaaauuuuccaacugaaggccugagucccagccaggucaccauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaacgcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugcuuuuguuguccaaccacaaaauggcaggugcacgacugauggcgugcucuuaggcaccacccaacugucucccgucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4645 - RNA, 1623 nt, Artificial Sequence; identical to SEQ ID NO: 4448
  capsid_protein_VP1__Norovirus__AII02635

SEQ ID NO: 4646 - RNA, 1608 nt, Artificial Sequence
  capsid_protein_VP1__Norovirus__AII02638
augaagauggcgucgaaugacgccgcuccaucuaaugauggugcagccggucucguaccagaggucaacaaugagaccauggcacuugaaccgguggcuggggcuucaauagccgccccacucaccggucaaaauaauguuauagaccccuggauuagauuaaacuuugugcaagcucccaauggagaguuuacaguuucaccccgcaauucgccuggggaaguccuacuaaacuuggaauuaggcccugaacuaaauccauauuuggcacaccuuuccagaauguacaaugguuaugcagguggaguugaggugcaaguacuacuggcugggaacgcguucacggcuggaaaacugguauucgccgcaguucccccucauuuuccauuagaaaacauaagcccuggucaaauaaccauguucccucauguaauuauugauguuaggacuuuagaaccaguccuauugccucuuccagauguuaggaacaauuucuuucacuacaaucagcaaaacgaaccgaggaugaggcuuguggcaaugcucuauaccccccuuaggucuaaugguucuggugaugauguauuuacugucuccuguagagugcuuacucgacccucuccugauuuugauuucaauuauuugguacccccuacaguugaaucuaaaacuaaacccuucacacuccccaucuugaccauaggggaguuaaccaauuccagauucccugugccuauagaugaacucuacacuagccccaaugagaguuuggugguacaaccccagaacgggagaugcgcgcuggauggggaguugcaggguacuacucagcuccuccccacggcgaucugcucguucaggggucggauuaaucagaaagugaguggagagaaccauguuuggaauaugcaagucaccaacauuaacggaaccccuuuugauccaacagaggauguuccagcuccucuagguacaccagauuucucuggcaagcucuuuggcguccuaagccagagggaccaugauaaugccuguaggagccaugaugcagugauugcaacuaauucugcuaaauuuaccccaaaauugggcgcuauacaaauuggcacaugggaacaagaugauguacacaucaaccaacccaccaaauuuacuccaguuggcuuguuugaaagugaagguuuuaaucaguggacacucccuaauuauucuggagccuuaacacucaacaugggguuggcccccccuguggcccccacauuuccuggcgagcaaauucuuuucuucagaucccacauuccucuuaaaggagguguggcagacccaguuauugauugucucuugccccaagaguggauccaacaucuuuaucaggagucagccccuucacaaacagauguagcacugaucagauucacaaauccagacacagggcguguccuauuugaagcaaaauugcacaggaguggcuacaucacaguggccaacacugguagcagaccaauuguggugccagcuaaugguuacuucagguuugacucuuggguuaaucaguuuuauucucucgcccccaugggaacugggaaugggcgcagaagggugcaguaa

SEQ ID NO: 4647 - RNA, 1623 nt, Artificial Sequence; identical to SEQ ID NO: 4506
  capsid_protein_VP1__Norovirus__AII02641

SEQ ID NO: 4648 - RNA, 1647 nt, Artificial Sequence
  capsid_protein_VP1__Norovirus__AII02644
augaagauggcgucgaaugacgccgcuccaucuaaugauggugccgccggccucgucccagagaucaacagugaggcaauggcgcuagagccaguggcgggugcagcgauagcagcaccccucacuggucagcaaaauauaauugaucccuggauuaugaauaauuuugugcaagcaccugguggugaguucacaguauccccuagaaauuccccuggugaaguucuucucaauuuggaauuggguccagaaauaaaucccuacuuggcccaucuugcuagaauguauaaugguuaugcagguggauuugaagugcaggugguccuagcuggaaaugcguuuacagcaggaaagauaaucuuugcagcuauucccccuaauuuuccaauugauaaucuaagugcagcacagaucacaauguguccacaugugauuguggauguuagacagcuggaaccagucaaccucccgaugccugauguucgcaauaacuuuuuccauuacaaucaggggucugauucgagauugcgccuaauugcaaugcuauauacaccucuuagggcaaauaacucuggggaugauguuuucacugugucuugcagagugcuaacuagaccuaguccugacuucucauuuaauuuucuugugccacccacuguggagucaaagacaaaacccuuuucccuccccauucugacuaucucugaaauguccaauucuagguucccaguaccaauugauucucugcacaccagcccuacugagaacauugucguccagugccagaauggacgcgucacccuugauggugaguugaugggcaccacccaacuuuuaccuagccaaaucugugcuuucaggggcaugcucaccagaucaacaagcagggccagugaccaggccgauacagcaaccccuagauuguuuaauuauuauuggcauauacaauuggauaaccuaaauggaacuccuuaugacccugcagaagauauaccaggcccccuagggacaccagauuuccggggcaaagucuuuggcguggccagccagagaaauccugaugccacgacuagggcacaugaagcaaagauagacacaacaucuggccgcuucaccccaaaauuaggcucacuagagauuuccacugagucuggagauuuugaucaaaaccaaccaacaagauucaccccaguuggcauugggguugaccaugaggcagauuuucaacaauggacucuucccgacuaugcuggccaguucacccacaacaugaacuuagccccagcuguugcucccaacuucccuggugagcagcuccuuuucuuccgcucacaguugccaucuucuggugggcgguccaacgggauucuagacugccuggucccccaagaauggguacagcacuucuaccaagaaucagcccccucccaaacucaaguggcccugguuagguaugucaacccugacacugguagaguguuauuugaggccaagcugcacaaauuagguuucaugacuauagccaagaguggugacucuccaauaacuguccccccaaauggauacuucagguuugaaucuugggugaaccccuuuuauacacuugcccccaugggaacugggaaugggcguagaaggauucaauaa

SEQ ID NO: 4649 - RNA, 1623 nt, Artificial Sequence; identical to SEQ ID NO: 4460
  capsid_protein_VP1__Norovirus__AII02647

SEQ ID NO: 4650 - RNA, 1623 nt, Artificial Sequence
  capsid_protein_VP1__Norovirus__AII02650
augaagauggcgucgagugacgccaacccaucugauggguccacagccaaccuugucccagaggucaauaaugagguuauggcuuuggagcccguaguuggugccgccauugcggcaccuguagcgggccaacaaaauguaauugaccccuggauuagaaacaauuuuguacaagccccugguggagaguuuacaguauccccaagaaacgcuccaggcgaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguccucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggacgucacucauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggacuuggacugucugcucccccaggaaugggugcaauauuucuaccaggaggcagccccagcacaaucugauguggcucugcuaagauuugugaauccggacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacgugcauuauaa

SEQ ID NO: 4651 - RNA, 1623 nt, Artificial Sequence
  capsid_protein_VP1__Norovirus__AII02653
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggagccuguguugauccccuuaccugauguuaggaauaauuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcacuuucagaggggaugucacccacauugcagguucucguaacuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggucauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugaugcggcucuauugagauuugugaauccagacacggguaggguccuguuugagugcaaacuucauaaaucaggcuaugucacaguggcucacaccggucagcaugauuuggucaucccccccaauggcuacuuuagguuugauuccuggguuaaucaguucuacacgcuugcccccaugggaaacggaacggggcguaggcgcgccuuauaa

SEQ ID NO: 4652 - RNA, 1647 nt, Artificial Sequence
  capsid_protein_VP1__Norovirus__AII02656
augaagauggcgucgaaugacgccgcuccaucuaaugauggugccgccggccucgucccagagaucaacagugaggcaauggcgcuagagccaguggcgggugcagcgauagcagcaccccucacuggucagcaaaauauaauugaucccuggauuaugaauaauuuugugcaagcaccugguggugaguucacaguauccccuagaaauuccccuggugaaguucuucucaauuuggaauuggguccagaaauaaaucccuacuuggcccaucuugcuagaauguauaaugguuaugcagguggauuugaagugcaggugguccuagcuggaaaugcguuuacagcaggaaagauaaucuuugcagcuauucccccuaauuuuccaauugauaaucuaagugcagcacaaaucacaauguguccacaugugauuguggauguuagacagcuggaaccagucaaccucccgaugccugacguacgcaauaacuuuuuccauuacaaucaggggucugauucgagauugcgccuaauugcaaugcuauauacaccucuuagggcaaauaacucuggggaugauguuuucacugugucuugcagagugcuaacuagaccuaguccugacuucucauuuaauuuccuugugccacccacuguggagucaaagacaaaacccuuuucccuccccauucugacuaucucugaaauguccaauucuagguucccaguaccaauugauucucugcacaccagcccuacugagaacauuguuguccagugccagaauggacgcgucacccuugauggugaguugaugggcaccacccaacuuuuaccuagccaaaucugugcuuucaggggcaugcucaccagaucaacaagcagggccagugaccaggccgauacagcaaccccuagauuguuuaauuauuauuggcauauacaauuggauaaccuaaauggaacuccuuaugacccugcagaagauauaccaggcccccuagggacaccagauuuccggggcaaagucuuuggcguggccagccagagaaauccugaugccacgacuagggcacaugaagcaaagauagacacaacaucuggccgcuucaccccaaaauuaggcucacuagagauuuccacugagucuggagauuuugaucaaaaccaaccaacaagauucaccccaguuggcauugggguugaccaugaggcagauuuucaacaauggacucuucccgacuaugcuggccaguucacccacaacaugaacuuagccccagcuguugcucccaacuucccuggugagcagcuccuuuucuuccgcucacaguugccaucuucuggugggcgguccaacgggauucuagacugccuggucccccaagaauggguacagcacuucuaccaagaaucagcccccucccaaacucaaguggcccugguuagguaugucaacccugacacugguagaguguuauuugaggccaagcugcacaaauuagguuucaugacuauagccaagaguggugacucuccaauaacuguccccccaaauggauacuucagguuugaaucuugggugaaccccuuuuauacacuugcccccaugggaacugggaaugggcguagaaggauucaauaa

SEQ ID NO: 4653 - RNA, 1623 nt, Artificial Sequence; identical to SEQ ID NO: 4425
  capsid_protein_VP1__Norovirus__AII02659

SEQ ID NO: 4654 - RNA, 1647 nt, Artificial Sequence
  capsid_protein_VP1__Norovirus__AII02662
augaagauggcgucgaaugacgccgcuccaucuaaugauggugccgccggccucgucccagagaucaacagugaggcaauggcgcuagagccaguggcgggugcagcgauagcagcaccccucacuggucagcaaaauauaauugaucccuggauuaugaauaauuuugugcaagcaccugguggugaguucacaguauccccuagaaauuccccuggugaaguucuucucaauuuggaauuggguccagaaauaaaucccuacuuggcccaucuugcuagaauguauaaugguuaugcagguggauuugaagugcaggugguccuagcuggaaaugcguuuacagcaggaaagauaaucuuugcagcuauucccccuaauuuuccaauugauaaucuaagugcagcacagaucacaaugugcccacaugugauuguggauguuagacagcuggaaccagucaaccucccgaugccugacguucgcaauaacuuuuuccauuacaaucaggggucugauucgagauugcgccuaauugcaaugcuguauacaccucuuagggcaaauaacucuggggaugauguuuucacugugucuugcagagugcuaacuagaccuaguccugacuucucauuuaauuuccuugugccacccacuguggagucaaagacaaaacccuuuucccuccccauucugacuaucucugaaauguccaauucuagguucccaguaccaauugauucucugcacaccaguccuacugagaacauuguuguccagugccagaacggacgcgucacccuugauggugaguugaugggcaccacucaacuuuuaccuagccaaaucugugcuuucaggggcaugcucaccagaucaacaagcagggccagugaccaggccgauacagcaaccccuagauuguuuaauuauuauuggcauauacaauuggauaaccuaaauggaacuccuuaugacccugcagaagauauaccaggcccccuagggacaccagauuuccggggcaaagucuuuggcguggccagccagagaaauccugaugccacgacuagggcacaugaagcaaagauagacacaacaucuggccgcuucacuccaaaauuaggcucacuagagauuuccacugagucuggagauuuugaucaaaaccaaccaacaagauucaccccaguuggcauugggguugaccaugaggcagauuuucaacaauggacucuucccgacuacgcuggccaguucacccacaacaugaacuuagccccagcuguugcccccaacuuccccggugagcagcuccuuuucuuucgcucacaguugccaucuucuggcgggcgguccaacgggauucuagacugccuggucccccaagaauggguacagcacuucuaucaagaaucagcccccucccaaacucaaguggcccugguuagguaugucaacccugacacugguagaguguuauuugaggccaagcugcacaaauuagguuucaugacuauagccaagaguggugacucuccaauaacuguccccccaaauggauacuucagguuugaaucuugggugaaccccuuuuauacgcuugcccccaugggaacugggaaugggcguagaaggauucaauaa

SEQ ID NO: 4655 - RNA, 1623 nt, Artificial Sequence; identical to SEQ ID NO: 4441
  capsid_protein_VP1__Norovirus__AII02665

SEQ ID NO: 4656 - RNA, 1623 nt, Artificial Sequence; identical to SEQ ID NO: 4556
  capsid_protein_VP1__Norovirus__AII02668

SEQ ID NO: 4657 - RNA, 1623 nt, Artificial Sequence; identical to SEQ ID NO: 4444
  capsid_protein_VP1__Norovirus__AII02671

SEQ ID NO: 4658 - RNA, 1623 nt, Artificial Sequence
  capsid_protein_VP1__Norovirus__AII02674
augaagauggcgucgaaugacgccaacccaucugauggguccgcagccaaccucgucccagaggucaacaaugagguuauggcuuuggagcccguugucggugccgcuauugcggcaccuguagcgggccaacaaaauguaauugaccccuggauuaggaauaauuuuguacaagccccugguggagaauucacaguauccccuagaaacgcuccaggugaaauacuauggagcgcgcccuuaggcccugaucugaaucccuaccuaucccauuuggccagaauguauaaugguuaugcagguggcuuugaagugcaggugauccucgcggggaacgcguucaccgccgggaaaauuauauuugcagcaguuccaccaaauuuuccaacugaaggcuugagccccagccagguuacuauguucccccacauaauaguagauguuaggcaacuggaaccuguguugauccccuuaccugauguuaggaauaacuucuaucauuauaaucagucaaaugauucuaccauuaaauugauagcaaugcuguacacaccacuuagagcuaauaaugcuggggaagaugucuucacagucucuugucgaguccucacgaggccauccccugacuuugauuuuauauuuuuggugccacccacaguugagucaagaacuaaaccauuuacugucccaaucuuaacuguugaagaaaugaccaauucaagauuccccaucccuuuggaaaaguuguucacgggccccagcggugccuuuauuguucaaccacaaaaugguagaugcacgacugauggcgugcucuuaggcaccacccaacugucuccugucaacaucugcaccuucagaggggaugucacccacauugcagguucucgcaauuacacgaugaauuuggcuucucuaaauuggaauaauuaugacccaacagaagaaauuccagccccucugggaacuccagauuucgugggaaagauccaaggugugcucacucaaaccacaaagggagauggcucgacccguggccauaaagcaacaguuuacacugggagugcccccuuuacuccaaagcugggcaguguucaauucaguacugacacagaaaaugauuuugaagcucaccaaaacacaaaauucaccccagucggugucauccaggaugguggcaccacccaccgaaaugaaccccaacaaugggugcucccaaguuauucagguagagauguccacaauguacaccuggccccugcuguagcccccacuuuuccgggugaacaacuucuuuucuucagguccacuaugcccggaugcaguggguaucccaacauggauuuggauugccuacucccucaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucauccccccuaauggcuauuuuagguuugacuccuggguuaaccaauucuacacacuugcccccaugggaaauggaacggggcguagacgugcuuuauaa

SEQ ID NO: 4659 - RNA, 1623 nt, Artificial Sequence
  capsid_protein_VP1__Norovirus__AII02677
augaagauggcgucgagugacgccaacccaucugacggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuugucguucaaccacaaaacggcaggugcacgacugauggcgugcuccuagguacuacccaacugucucccgucaacaucugcaccuucagaggggacgucacccauauuucaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacagugggugcucccaaguuacucaggcagaaacauucauaaugugcaccuggcccccgcuguagcccccacuuucccgggcgagcagcuccucuucuucagaucuacuaugcccgggugcagcggguaccccaacauggacuuggacugucuucucccccaggaaugggugcaauauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 4660 - RNA, 1623 nt, Artificial Sequence
  capsid_protein_VP1__Norovirus__AII02680
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaagucacuauguucccccacauaauaguagauguuaggcaauuggaaccuguguugauccccuuaccugauguuaggaauaacuucuaucauuauaaucagauaaaugauccuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguagcaccacccaccgaaaugaaccccaacaaugggugcucccaaguuauucagguagagauauucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4661 - RNA, 1623 nt, Artificial Sequence; identical to SEQ ID NO: 4453
  capsid_protein_VP1__Norovirus__AII02683

SEQ ID NO: 4662 - RNA, 1623 nt, Artificial Sequence; identical to SEQ ID NO: 4451
  capsid_protein_VP1__Norovirus__AII02689

SEQ ID NO: 4663 - RNA, 1623 nt, Artificial Sequence; identical to SEQ ID NO: 4512
  capsid_protein_VP1__Norovirus__AII02692

SEQ ID NO: 4664 - RNA, 1623 nt, Artificial Sequence; identical to SEQ ID NO: 4505
  capsid_protein_VP1__Norovirus__AII02695

SEQ ID NO: 4665 - RNA, 1623 nt, Artificial Sequence; identical to SEQ ID NO: 4462
  capsid_protein_VP1__Norovirus__AII02698

SEQ ID NO: 4666 - RNA, 1623 nt, Artificial Sequence; identical to SEQ ID NO: 4439
  capsid_protein_VP1__Norovirus__AII02701

SEQ ID NO: 4667 - RNA, 1623 nt, Artificial Sequence; identical to SEQ ID NO: 4442
  capsid_protein_VP1__Norovirus__AII02707

SEQ ID NO: 4668 - RNA, 1623 nt, Artificial Sequence; identical to SEQ ID NO: 4555
  capsid_protein_VP1__Norovirus__AII02710

SEQ ID NO: 4669 - RNA, 1647 nt, Artificial Sequence
  capsid_protein_VP1__Norovirus__AII02713
augaagauggcgucgaaugacgccgcuccaucuaaugauggugccgccggccucgucccagagaucaacagugaggcaauggcgcuagagccaguggcgggugcagcgauagcagcaccccucacuggucagcaaaauauaauugaucccuggauuaugaauaauuuugugcaagcaccugguggugaguucacaguauccccuagaaauuccccuggugaaguucuucucaauuuggaauuggguccagaaauaaaucccuacuuggcccaucuugcuagaauguauaaugguuaugcagguggauuugaagugcaggugguccuagcuggaaaugcguuuacagcaggaaagauaaucuuugcagcuauucccccuaauuuuccaauugauaaucuaagugcagcacagaucacaaugugcccacaugugauuguggauguuagacagcuggaaccagucaaccucccgaugccugacguucgcaauaacuuuuuccauuacaaucaggggucugauucgagauugcgccuaauugcaaugcuguauacaccucuuagggcaaauaacucuggggaugauguuuucacugugucuugcagagugcuaacuagaccuaguccugacuucucauuuaauuuccuugugccacccacuguggagucaaagacaaaacccuuuucccuccccauucugaccaucucugaaauguccaauucuagguucccaguaccaauugauucucugcacaccaguccuacugagaacauuguuguccagugccagaacggacgcgucacccuugauggugaguugaugggcaccacucaacuuuuaccuagccaaaucugugcuuucaggggcaugcucaccagaucaacaagcagggccagugaccaggccgauacagcaaccccuagauuguuuaauuauuauuggcauauacaauuggauaaccuaaauggaacuccuuaugacccugcagaagauauaccaggcccccuagggacaccagauuuccggggcaaagucuuuggcguggccagccagagaaauccugaugccacgacuagggcacaugaagcaaagauagacacaacaucuggccgcuucacuccaaaauuaggcucacuagagauuuccacugagucuggagauuuugaucaaaaccaaccaacaauauucaccccaguuggcauugggguugaccaugaggcagauuuucaacaauggacucuucccgacuacgcuggccaguucacccacaacaugaacuuagccccagcuguugcccccaacuuccccggugagcagcuccuuuucuuucgcucacaguugccaucuucuggcgggcgguccaacgggauucuagacugccuggucccccaagaauggguacagcacuucuaucaagaaucagcccccucccaaacucaaguggcccugguuagguaugucaacccugacacugguagaguguuauuugaggccaagcugcacaaauuagguuucaugacuauagccaagaguggugacucuccaauaacuguccccccaaauggauacuucagguuugaaucuugggugaaccccuuuuauacacuugcccccaugggaacugggaaugggcguagaaggauucaauaa

SEQ ID NO: 4670 - RNA, 1647 nt, Artificial Sequence
  capsid_protein_VP1__Norovirus__AII02716
augaagauggcgucgaaugacgccgcuccaucuaaugauggugccgccggccucgucccagagaucaacagugaggcaauggcgcuagagccaguggcgggugcagcgauagcagcaccccucacuggucagcaaaauauaauugaucccuggauuaugaauaauuuugugcaagcaccugguggugaguucacaguauccccuagaaauuccccuggugaaguucuucucaauuuggaauuggguccagaaauaaaucccuacuuggcccaucuugcuagaauguauaaugguuaugcagguggauuugaagugcaggugguccuagcuggaaaugcguuuacagcaggaaagauaaucuuugcagccauucccccuaauuuuccaauugauaaucuaagugcagcacagaucacaaugugcccacaugugauuguggauguuagacagcuggaaccagucaaccucccgaugccugacguucgcaauaacuuuuuccauuacaaucaggggucugauucgagauugcgccuaauugcaaugcuguauacaccucuuagggcaaauaacucuggggaugauguuuucacugugucuugcagagugcuaacuagaccuaguccugacuucucauuuaauuuccuugugccacccacuguggagucaaagacaaaacccuuuucccuccccauucuaacuaucucugaaauguccaauucuagguucccaguaccaauugauucucugcacaccaguccuacugagaacauuguuguccagugccagaacggacgcgucacccuugauggugaguugaugggcaccacucaacuuuuaccuagccaaaucugugcuuucaggggcaugcucaccagaucaacaagcagggccagugaccaggccgauacagcaaccccuagauuguuuaauuauuauuggcauauacaauuggauaaccuaaauggaacuccuuaugacccugcagaagauauaccaggcccccuagggacaccagauuuccggggcaaagucuuuggcguggccagccagagaaauccugaugccacgacuagggcacaugaagcaaagauagacacaacaucuggccgcuucacuccaaaauuaggcucacuagagauuuccacugaaucuggagauuuugaucaaaaucaaccaacaagauucaccccaguuggcauugggguugaccacgaggcagauuuucaacaauggacucuucccgacuacgcuggccaguucacccacaacaugaacuuagccccagcuguugcucccaacuuccccggugagcagcuccuuuucuuucgcucacaguugccaucuucuggcgggcgguccaacgggauucuagacugccuggucccccaagaaugggugcagcacuucuaucaagaaucggcccccucccaaacucaaguggcccugguuagguaugucaacccugacacugguagaguguuauuugaggccaagcugcacaaauuagguuucaugacuauagccaagaguggugacucuccaauaacuguccccccaaauggauacuucagguuugaaucuugggugaaccccuuuuauacgcuugcccccaugggaacugggaaugggcguagaaggauucaauaa

SEQ ID NO: 4671 - RNA, 1650 nt, Artificial Sequence
  capsid_protein_VP1__Norovirus__AII02719
augaagauggcgucgaaugacgcugcuccaucgaaugauggugcugccaaccucguaccagaggccaacaaugagguuauggcacuugaaccgguggugggagccucaaucgcggcuccugucgucggccaacaaaacauaauugaccccuggauuagagaaaauuuuguccaagcaccacagggcgaguucaccgucucaccgagaaacucgccuggugagaugcuauuaaaucuugaauuaggcccagaacucaacccuuaccuaagccauuugucccgcauguauaacggguaugcugguggcaugcagguucaggugguccuggcugggaaugcguucacagcugggaaaaucaucuuugccgccgugccaccacauuuucccguagaaaacaucaaugcagcccaaauaaccauguguccccauguaauuguugaugugagacaacuugaaccagugcuuuuaccccucccugauauaaggaacagguucuuucauuacaaucaagaggauaccccccggaugaggcuuguggcaaugcuuuacacuccccugagggcuaauucuggugaagauguuuuuacugucucuuguaggguuuuaacccguccugccccugauuuugaauucacuuucuuggugccaccaaccguugaaucaaagacuaaaccuuuuacacuacccauauuaacucuuggugagcuauccaacucuagauucccagccccgauagacauguuguacacugacccaaaugaggggauugugguccaaccacaaaaugguaggugcacucuugauggcacucuacaaggcaccacacaacugguccccacccaaauuugugcuuucaggggcauacugauuggccagacaucaaggucuccagacucagacucaacugacucagccccucggagaagggaucacccacuccauaugcaauuagagaaucuugauggcacgcaguaugauccaacugaugaagugccagcagcccuuggugccguugacuucaaggggaccauuuuuggaguggccagucagagagacacgucagggacacaagugggggcaacccgagcucaugaggugaucaucaacacuaccgauccuagguauacaccaaaacugggauccguccucauguauucagagucgcaagacuuugagacuggacagccgauccgcuucacaccuauaggaaugggugagaacgacuggcaccagugggagcugccuaacuacucuggacgccugacccugaacaugaaccuugccccagcuguugcuccugcuuuucccggugagaggauucuuuucuucaggucaauagucccaucugcugguggcuacgggucuggacagauagacugccucuuaccacaggaguggguucagcauuucuaccaggaagcugcaccgucccaaucugccguggcacucauuagguaugucaacccugacacaggcagaaacauuuuugaggcuaaauugcacagggaagguuucaucaccguggcaaauucuggcaauaacccuauuguugucccuccuaauggauauuucagauuugaagcuugggugaaucaauuuuacacuuugacccccaugggaacuggucaggggcgcaggaggaaucaauaa

SEQ ID NO: 4672 - RNA, 1650 nt, Artificial Sequence
  capsid_protein_VP1__Norovirus__AII02722
augaagauggcgucgaaugacgcugcuccaucgaaugauggugcugccaaccucguaccagaggccaacaaugagguuauggcacuugaaccgguggcgggagccucaaucgcggcuccugucgucggccaacaaaacauaauugaccccuggauuagagaaaauuuuguccaagcaccacagggcgaguucaccguuucaccgagaaacucgccuggugagaugcuauuaaaucuugaauuaggcccagaacucaacccuuaccuaagccauuugucccgcauguauaacggguaugcugguggcaugcagguucaggugguccuggcugggaaugcguucacagcugggaaaaucaucuuugccgccgugccaccacauuuucccguagaaaacaucaaugcagcucaaauuaccauguguccccauguaauuguugaugugaggcaacuugaaccagugcuuuuaccccucccugacauaaggaacagguucuuucauuacaaucaagaggauaccccccggaugaggcuuguggcaaugcuuuacacuccccugagggcuaauucuggugaagauguuuuuacugucucuuguaggguuuuaacccguccugccccugauuuugaauucacuuucuuggugccaccaaccguugaaucaaagacuaaaccuuuuacacuacccauacuaacucuuggugagcuauccaacucuagauucccagccccgauagacauguuguacacugacccaaaugaggggauugugguccaaccacaaaaugguaggugcacucuugauggcacucugcaaggcaccacacaacugguccccacccaaauuugugcuuucaggggcagacuaauuggccagacaucaaggucuccagacuuagacucaacugacucagccccucggagaagggaucacccacuccacaugcaauuagagaaucuugauggcacgcaguaugauccaacugaugaagugccagcagcccuuggugccguugacuucaaggggaccauuuuuggaguggccagccagagagacacgucagggagucaagugggggcaacccgagcucaugaggugaccaucaacacuaccgauccuagguacacaccaaaacugggauccguccucauguauucagagucgcaagacuuugagacuggacagccgauccgcuucacaccuauaggaaugggugaggacgacuggcaccagugggagcugccuaacuacucuggacgccugacccugaacaugaaccuugccccagcuguugcuccugcuuuucccggugagaggauucuuuucuucaggucaauagucccaucugcugguggcuacgggucuggacagauagacugccucuuaccacaggaguggguucagcauuucuaccaggaagcugcaccgucccaaucugccguggcacucauuagguaugucaacccugacacaggcagaaacauuuuugaggcuaaauugcacagggaagguuucaucaccguggcaaauucuggcaauaaccccauuguuguccccccuaauggauauuucagauuugaagcuugggugaaucaauuuuacacuuugacccccaugggaacuggucaggggcgcaggaggaaucaauaa

SEQ ID NO: 4673 - RNA, 1623 nt, Artificial Sequence
  capsid_protein_VP1__Norovirus__AII02725
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaccccuaccuaucccauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccguuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcacuacccaccgaaaugaaccccaacaaugggugcucccaaguuauucagguagagauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcgucggcgcgccuuauaa

SEQ ID NO: 4674 - RNA, 1623 nt, Artificial Sequence
  capsid_protein_VP1__Norovirus__AII02728
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaagucacuauguucccccacauaauaguagauguuaggcaauuggaaccuguguugauccccuuaccugauguuaggaauaacuucuaucauuauaaucagacaaaugauccuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccaucccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucgugauuacacaaugaauuuggcaucucuaaauuggaacaauuaugacccaacagaagaaauuccagccccucugggaacuccagauuucgugggaaagauccaaggugugcucacucaaaccacaagaggagauggcucgacccguggccauaaagcuacaguuuacacugggagugcccccuuugcuccaaaacugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguucgagugcaaacuucauaaaucaggcuaugucacaguggcucacaccggucagcaugauuuggucauccccccuaauggcuauuuuagguuugauucuugggucaaucaguucuacacgcuugcccccaugggaaacggaacggggcguaggcgcgccuuauaa

SEQ ID NO: 4675 - RNA, 1653 nt, Artificial Sequence
  capsid_protein_VP1__Norovirus__AII02731
augaagauggcgucgaaugacgccgcuccaucaaaugauggugcugccaaccucguaccagaggccaacaaugagguuauggcacuugaaccgguggugggagcuucaaucgcagcuccuguugucggucagcaaaauauaauugaccccuggauuagagaaaauuuuguccaagcaccacagggcgaguuuacuguuucaccaaggaacucgcccggugagaugcuucuaaaucuugaauugggcccagaacuuaaccccuauuugagucauuugucccgcauguacaauggguaugcugguggcaugcagguucaggugguccuagcugggaaugcguucacagcugggaagaucaucuuugccgcugugccaccacacuucccuguggauaauauuagugcagcccagauaacuauguguccccaugugauuguugaugugagacagcuugaaccagugcuucugccucuccccgauauaaggaacagguucuuccauuacaaucaggaaaacaccccccggaugagacucguggccaugcucuacacgccucuaagggcuaauucuggagaggacguguucacuguguccuguaggguucugacucgccccgcuccagauuuugaauuuacauuuuuaguuccaccaacuguugaaucaaaaacaaaacccuucacuuuaccuauucuaacccuuggugaguugucuaauucccguuuuccugcugccauagacaugcuuuauacugaucccaaugaaucgauaguuguucagccccaaaaugguagaugcacccuugauggcacauugcaaggcacaacacaauugguuccaacacagauuugugccuuuagagguaccuugaucagccagacugcgagagcggccgauucaacggauuccccccagagagcccguaaucacccguuacauguccaggucaagaaccuagauggcacacaguaugacccaacagaugacaucccugcaguccugggggcuauugauuucaaagguacaguguucggaguggcaagucagagggacgucucuggaacacaagaacagggccauuaugccacccgggcccaugaagcacacauugacacaacugacccaaaguaugcaccuaaauuaggcacaauccucaucaaaucugaaucuacugauuucaacacaaaucagcccauuagguucacuccagugggcaugggugauaacaauuggagacagugggaacugccugacuauucugguaguuugacucuaaauaugaaccuugcccccgcuguuuccccauccuucccuggugaacgaauccuuuucuuuaggucuauaguaccaucagcuggaggcuacgggucuggcuauauagacugucucauaccccaggaaugggugcaacacuucuaccaggaggcagcaccuucacaaucugcuguugcacugguuagguaugucaaccccgacacugggcguaacaucuuugaggccaaauugcauagagaaggguuccucaccguggccaauucuggaaauaauccuauugugguucccccuaaugguuauuuuagauuugaggcuuggguuaaucaauuuuacacacuugcccccaugggaucuggacaggggcguagaagggcucaguaa

SEQ ID NO: 4676 - RNA, 1623 nt, Artificial Sequence; identical to SEQ ID NO: 4482
  capsid_protein_VP1__Norovirus__AII02734

SEQ ID NO: 4677 - RNA, 1623 nt, Artificial Sequence; identical to SEQ ID NO: 4501
  capsid_protein_VP1__Norovirus__AII02737

SEQ ID NO: 4678 - RNA, 1623 nt, Artificial Sequence
  capsid_protein_VP1__Norovirus__AII02740
augaagauggcgccgaaugacgccaacccaucugauggguccgcagccaaccucgucccagaggucagcaaugagguuauggcuuuggaacccguugucggugccgcuauugcggcgccuguagcgggccaacaaaauguaauugaccccuggauuagaaauaauuuuguacaagccccugguggagaguucacaguauccccuagaaacgcuccaggugaaauacuauggggcgcgcccuuaggcccugaccugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccucuggaaaaguuguucacgggucccagcggugccuuuguuguccaaccacaaaauggcagaugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccaccaugcccggaugcagcggguaucccaacauggauuuggauugccuacucccccaggagugggugcagcacuucuaccaagaggcagcuccagcacaaucugauguggcucuacugagauuugugaauccagacacggguaggguccuguuugagugcaaacuucauaaaucagguuaugucacaguggcucacaacggucagcaugauuuggucaucccccccaauggcuauuuuagguuugauuccuggguuaaucaauucuacacacuugcccccaugggaaacggaacggggcguaggcgcgcuuuauaa

SEQ ID NO: 4679 - RNA, 1623 nt, Artificial Sequence
  capsid_protein_VP1__Norovirus__AII02743
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguacaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucgugauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4680 - RNA, 1623 nt, Artificial Sequence
  capsid_protein_VP1__Norovirus__AII02746
augaagauggcgucgaaugacgccaacccaucugauggguccgcagccaaccucgucccagaggucaacaaugagguuauggcuuuggagcccguugucggugccgcuauugcggcaccuguagcgggccaacaaaauguaauugaccccuggauuaggaauaauuuuguacaagccccugguggagaauucacaguauccccuagaaacgcuccaggugaaauacuauggagcgcgcccuuaggcccugaucugaaccccuaccuaucccauuuggccagaauguauaaugguuaugcagguggcuuugaagugcaggugauccucgcggggaacgcguucaccgccgggaaaauuauauuugcagcaguuccaccaaauuuuccaacugaaggcuugagccccagccagguuacuauguucccccacauaauaguagauguuaggcaacuggaaccuguguugauccccuuaccugauguuaggaauaacuucuaucauuauaaucagucaaaugauucuaccauuaaauugauagcaaugcuguacacaccacuuagagcuaauaaugcuggggaagaugucuucacagucucuugucgaguccucacgaggccauccccugacuuugauuuuauauuuuuggugccacccacaguugagucaagaacuaaaccauuuacugucccaaucuuaacuguugaagaaaugaccaauucaagauuccccaucccuuuggaaaaguuguucacgggccccagcggugccuuuauuguucaaccacaaaaugguagaugcacgacugauggcgugcucuuaggcaccacccaacugucuccugucaacaucugcaccuucagaggggaugucacccacauugcagguucucgcaauuacacgaugaauuuggcuucucuaaauuggaauaauuaugacccaacagaagaaauuccagccccucugggaacuccagauuucgugggaaagauccaaggugugcucacucaaaccacaaagggagauggcucgacccguggccauaaagcaacaguuuacacugggagugcccccuuuacuccaaagcugggcaguguucaauucaguacugacacagaaaaugauuuugaagcucaccaaaacacaaaauucaccccagucggugucauccaggaugguggcaccacccaccgaaaugaaccccaacaaugggugcucccaaguuauucagguagagauguccacaauguacaccuggccccugcuguagcccccacuuuuccgggugaacaacuucuuuucuucagguccacuaugcccggaugcaguggguaucccaacauggauuuggauugccuacucccucaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucauccccccuaauggcuauuuuagguuugacuccuggguuaaccaauucuacacacuugcccccaugggaaauggaacggggcguagacgugcuuuauaa

SEQ ID NO: 4681 - RNA, 1623 nt, Artificial Sequence; identical to SEQ ID NO: 4503
  capsid_protein_VP1__Norovirus__AII02749

SEQ ID NO: 4682 - RNA, 1623 nt, Artificial Sequence; identical to SEQ ID NO: 4521
  capsid_protein_VP1__Norovirus__AII02752

SEQ ID NO: 4683 - RNA, 1623 nt, Artificial Sequence; identical to SEQ ID NO: 4543
  capsid_protein_VP1__Norovirus__AII02758

SEQ ID NO: 4684 - RNA, 1623 nt, Artificial Sequence
  capsid_protein_VP1__Norovirus__AII02761
augaagauggcgucgagugacgccaacccguccgauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccaggauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccaccuaauaguagauguuaggcaauuggaaccuguguugauucccuuacccgauguuaggaauaauuucuaccauuacaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauucccuuggaaaaguuguucacgggccccaguagugccuuuguuguucaaccacaaaacggcaggugcacgacugauggcgugcuccuagguacuacccaacugucucccgucaacaucugcaccuucagaggggaugucacccauauuucagguagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugagccccaacaaugggugcucccaaguuacucaggcagaaacauucacaaugugcaccuggcccccgcuguagcccccacuuucccgggcgagcagcuccucuucuucagaucuacuaugcccgggugcagcggguaccccaacauggacuuggacugucugcucccccaggaaugggugcaguauuucuaccaggaggcagccccagcacaaucugauguggcucuguuaagauuugugaacccggauacagguaggguuuuguuugaguguaagcuucauaaaucaggcuauguuacaguggcucacacuggccaacaugauuuaguuaucccccccaaugguuauuuuagauuugauuccugggucaaccaauucuacacacuugcccccaugggaaaugggacggggcguagacgugcauuauaa

SEQ ID NO: 4685 - RNA, 1623 nt, Artificial Sequence
  capsid_protein_VP1__Norovirus__AII02764
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucacauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauuaauagcaaugcuguauacaccacuuagggccaauaacgcuggggaagaugucuucacagucucuugucgaguccucacuaggccguccccugauuuugauuuuauauuuuuggugccacccacaguugagucaagaacuaaaccauuuacugucccaaucuugaccguugaagaaaugaccaauucaagauuccccauuccuuuggaaaaguuguucacgggucccagcggugcuuuuguuguccaaccacaaaauggcaggugcacgacugauggcgugcucuuaggcaccacccaacugucucccgucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaucaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuccuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4686 - RNA, 1623 nt, Artificial Sequence; identical to SEQ ID NO: 4480
  capsid_protein_VP1__Norovirus__AII02767

SEQ ID NO: 4687 - RNA, 1647 nt, Artificial Sequence
  capsid_protein_VP1__Norovirus__AII02770
augaagauggcgucgaaugacgccgcuccaucuaaugauggugccgccggccucgucccagagaucaacagugaggcaauggcgcuagagccaguggcgggugcagcgauagcagcaccccucacuggucagcaaaauauaauugaucccuggauuaugaauaauuuugugcaagcaccugguggugaguucacaguauccccuagaaauuccccuggugaaguucuucucaauuuggaauuggguccagaaauaaaucccuacuuggcccaucuugcuagaauguauaaugguuaugcagguggauuugaagugcaggugguccuagcuggaaaugcguuuacagcaggaaagauaaucuuugcagcuauucccccuaauuuuccaauugauaaucuaagugcagcacagaucacaaugugcccacaugugauuguggauguuagacagcuggaaccagucaaccucccgaugccugacguucgcaauaacuuuuuccauuacaaucaggggucugauucgagauugcgccuaauugcaaugcuguauacaccucuuagggcaaauaacucuggggaugauguuuucacugugucuugcagagugcuaacuagaccuaguccugacuucucauuuaauuuccuugugccacccacuguggagucaaagacaaaacccuuuucccuccccauucugacuaucucugaaauguccaauucuagguucccaguaccaauugauucucugcacaccaguccuacugagaacauuguuguccagugccagaacggacgcgucacccuugauggugaguugaugggcaccacucaacuuuuaccuagccaaaucugugcuuucaggggcaugcucaccaggucaacaagcagggccagugaccaggccgauacagcaaccccuagauuguuuaauuauuauuggcauauacaauuggauaaccuaaauggaacuccuuaugacccugcagaagauauaccaggcccccuagggacaccagauuuccggggcaaagucuuuggcguggccagccagagaaauccugaugccacgacuagggcacaugaagcaaagauagacacaacaucuggccgcuucacuccaaaauuaggcucacuagagauuuccacugagucuggagauuuugaucaaaaccaaccaacaagauucaccccaguuggcauugggguugaccaugaggcagauuuucaacaauggacucuucccgacuacgcuggucaguucacccacaacaugaacuuagccccagcuguugcccccaacuuccccggugagcagcuccuuuucuuucgcucacaguugccaucuucuggcggucgguccaacgggauucuagacugccuggucccccaagaauggguacagcacuucuaucaagaaucagcccccucccaaacucaaguggcccugguuagguaugucaacccugacacugguagaguguuauuugaggccaagcugcacaaauuagguuucaugacuauagccaagaguggugacucuccaauaacuguccccccaaauggauacuucagguuugaaucuugggugaaccccuuuuauacacuugcccccaugggaacugggaaugggcguagaaggauucaauaa

SEQ ID NO: 4688 - RNA, 1623 nt, Artificial Sequence; identical to SEQ ID NO: 4502
  capsid_protein_VP1__Norovirus__AII02773

SEQ ID NO: 4689 - RNA, 1650 nt, Artificial Sequence
  capsid_protein_VP1__Norovirus__AII02776
augaagauggcgucgaaugacgcugcuccaucgaacgauggugcugccaaccucguaccagaggccaacaaugagguuauggcacuugaaccgguggugggagccucaaucgcggcuccugucgucggccaacaaaacauaauugaccccuggauuagagaaaauuuuguccaagcaccacagggcgaguucaccgucucaccgagaaacucgccuggugagaugcuauuaaaucuugaauuaggcccagaacucaacccuuaccuaagccauuugucccgcauguauaacggguaugcugguggcaugcagguucaggugguccuggcugggaaugcguucacagcugggaaaaucaucuuugccgccgugccaccacauuuucccguagaaaacaucaaugcagcccaaauaaccauguguccccauguaauuguugaugugagacaacuugaaccagugcuuuuaccccucccugauauaaggaacagguucuuucauuacaaucaagaggauaccccccggaugaggcuuguggcaaugcuuuacacuccccugagggcuaauucuggugaagauguuuuuacugucucuuguaggguuuuaacccguccugccccugauuuugaauucacuuucuuggugccaccaaccguugaaucaaagacuaaaccuuuuacacuaccuauauuaacucuuggugagcuauccaacucuagauucccagccccgauagacauguuguacacugacccaaaugaggggauugugguccaaccacaaaaugguaggugcacucuugauggcacucuacaaggcaccacacaacugguccccacccaaauuugugcuuucaggggcauacugauuggccagacaucaaggucuccagacucagacucaacugacucagccccucggagaagggaucacccacuccauaugcaauuagagaaucuugauggcacgcaguaugauccaacugaugaagugccagcagcccuuggugccguugacuucaaggggaccauuuuuggaguggccagucagagagacacgucagggagucaagugggggcaacccgagcucaugaggugaucaucaacacuaccgauccuagguauacaccaaaacugggauccguccucauguauucagagucgcaagacuuugagacuggacagccgauccgcuucacaccuauaggaaugggugagaacgacuggcaccagugggagcugccuaacuacucuggacgccugacccugaacaugaaccuugccccagcuguugcuccugcuuuucccggugagaggauucuuuucuucaggucaauagucccaucugcugguggcuacgggucuggacagauggacugccucuuaccacaggaguggauucagcauuucuaccaggaagcugcaccgucccaaucugccguggcacucauuagguaugucaacccugacacaggcagaaacauuuuugaggcuaaauugcacagggaagguuucaucaccguggcaaauucuggcaauaacccuauuguugucccuccuaauggauauuucagauuugaagcuugggugaaucaauuuuacacuuugacccccaugggaacuggucaggggcgcaggaggaaucaauaa

SEQ ID NO: 4690 - RNA, 1623 nt, Artificial Sequence; identical to SEQ ID NO: 4443
  capsid_protein_VP1__Norovirus__AII02779

SEQ ID NO: 4691 - RNA, 1623 nt, Artificial Sequence; identical to SEQ ID NO: 4503
  capsid_protein_VP1__Norovirus__AII02782

SEQ ID NO: 4692 - RNA, 1623 nt, Artificial Sequence
  capsid_protein_VP1__Norovirus__AII02785
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguacaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggagccuguguugauccccuuaccugauguuaggaauaauuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcacuuucagaggggaugucacccacauugcagguucucguaacuacacaaugaauuuggcaucuauaaauuggaacaauuaugacccaacagaagaaauuccagccccucugggaacuccagauuucgugggaaagauccaaggugugcucacucaaaccacaaaaggagauggcucgacccguggucacaaagcuacaguuuacacugggagugcccccuuuacuccaaagcugggcaguguucaauucaguacugacacagaaaaugauuuugaaacucaccaaaacacaaaauucaccccagucggugucauccaggauggugguaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugaugcggcucuauugagauuugugaauccagacacggguaggguccuguuugagugcaaacuucauaaaucaggcuaugucacaguggcucacaccggucagcaugauuuggucaucccccccaauggcuacuuuagguuugauuccuggguuaaucaguucuacacgcuugcccccaugggaaacggaacggggcguaggcgcgccuuauaa

SEQ ID NO: 4693 - RNA, 1647 nt, Artificial Sequence
  capsid_protein_VP1__Norovirus__AII02788
augaagauggcgucgaaugacgccgcuccaucuaaugauggugccgccggccucgucccagagaucaacagugaggcaauggcgcuagagccaguggcgggugcagcgauagcagcaccccucacuggucagcaaaauauaauugaucccuggauuaugaauaauuuugugcaagcaccugguggugaguucacaguauccccuagaaauuccccuggugaaguucuucucaauuuggaauuggguccagaaauaaaucccuacuuggcccaucuugcuagaauguauaaugguuaugcagguggauuugaagugcaggugguccuagcuggaaaugcguuuacagcaggaaagauaaucuuugcagcuauucccccuaauuuuccaauugauaaucuaagugcagcacagaucacaauguguccacaugugauuguggauguuagacagcuggaaccagucaaccucccgaugccugacguucgcaauaacuuuuuccauuacaaucaggggucugauucgagauugcgccuaauugcaaugcuauauacaccucuuagggcaaauaacucuggggaugauguuuucacugugucuugcagagugcuaacuagaccuaguccugacuucucauuuaauuuccuugugccacccacuguggagucaaagacaaaacccuuuucccuccccauucugacuaucucugaaauguccaauucuagguucccaguaccaauugauucucugcacaccagcccuacugagaacauugucguccagugccagaauggacgcgucacccuugauggugaguugaugggcaccacccaacuuuuaccuagccaaaucugugcuuucaggggcaugcucaccagaucaacaagcagggccagugaccaggccgauacagcaaccccuagauuguuuaauuauuauuggcauauacaauuggauaaccuaaauggaacuccuuaugacccugcagaagauauaccaggcccccuagggacaccagauuuccggggcaaagucuuuggcguggccagccagagaaauccugaugccacgacuagggcacaugaagcaaagauagacacaacaucuggccgcuucaccccaaaauuaggcucacuagagauuuccacugagucuggagauuuugaucaaaaccaaccaacaagauucaccccaguuggcauugggguugaccaugaggcagauuuucaacaauggacucuucccgacuaugcuggccaguucacccacaacaugaacuuagccccagcuguugcucccaacuucccuggugagcagcuccuuuucuuccgcucacaguugccaucuucuggugggcgguccaacgggauucuagacugccuggucccccaagaauggguacagcacuucuaccaagaaucagcccccucccaaacucaaguggcccugguuagguaugucaacccugacacugguagaguguuauuugaggccaagcugcacaaauuagguuucaugacuauagccaagaguggugacucuccaauaacuguccccccaaauggauacuucagguuugaaucuugggugaaccccuuuuauacacuugcccccaugggaacugggaaugggcguagaaggauucaauaa

SEQ ID NO: 4694 - RNA, 1647 nt, Artificial Sequence; identical to SEQ ID NO: 4687
  capsid_protein_VP1__Norovirus__AII02791

SEQ ID NO: 4695 - RNA, 1623 nt, Artificial Sequence
  capsid_protein_VP1__Norovirus__AII02794
augaagauggcgucgagugacgccaacccaucugauggguccacagccagccuugucccagaggucaacaaugagguuauggcuuuggagcccguaguuggugccgccauugcggcacccguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaguccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuaccugauguuaggaauaauuucuaccauuauaaucaaucaaaugaccccaccaucaaauugauagcaauguuguauacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggaugucacccauauuucaggcagucguaacuacacaaugaauuuggccucccaaaguuggaacaguuacgauccaacagaagaaaucccagccccucuaggaucuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucacaaugugcaccuggcccccgcuguagcccccacuuucccgggcgagcagcuccucuucuucagaucuacuaugcccggaugcagcggguaccccaacauggauuuggacugucugcucccccaggaaugggugcaguauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuucagauuugauuccugggucaaccaguucuacacacuugcccccaugggaaaugggacggggcguagacgugcauuauaa

SEQ ID NO: 4696 - RNA, 1623 nt, Artificial Sequence; identical to SEQ ID NO: 4441
  capsid_protein_VP1__Norovirus__AII02797

SEQ ID NO: 4697 - RNA, 1623 nt, Artificial Sequence; identical to SEQ ID NO: 4459
  capsid_protein_VP1__Norovirus__AII02800

SEQ ID NO: 4698 - RNA, 1623 nt, Artificial Sequence; identical to SEQ ID NO: 4674
  capsid_protein_VP1__Norovirus__AII02803

SEQ ID NO: 4699 - RNA, 1623 nt, Artificial Sequence; identical to SEQ ID NO: 4447
  capsid_protein_VP1__Norovirus__AII02806

SEQ ID NO: 4700 - RNA, 1623 nt, Artificial Sequence
  capsid_protein_VP1__Norovirus__AII02809
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuaggaauaauuuuguacaagccccugguggagaauucacaguauccccuagaaacgcuccaggugaaauacuauggagcgcgcccuuaggcccugaucugaaucccuaccuaucccauuuggccagaauguauaaugguuaugcagguggcuuugaagugcaggugauccucgcgggaaacgcguucaccgccggaaaaauuauauuugcagcaguuccaccaaauuuuccaacugaaggcuugagccccagccagguuacuauguucccccacauaauaguagauguuaggcaacuggaaccuguguugauccccuuaccugauguuaggaauaacuucuaucauuauaaucagucaaacgauuccaccauuaaauugauagcaaugcuguacacaccacuuagggcuaauaaugcuggggaagaugucuucacagucucuugucgaguccucacgaggccauccccugauuuugauuuuauauuuuuggugccacccacaguugagucaagaaccaaaccauuuacugucccaaucuuaacuguugaagaaaugaccaauucaagauuccccaucccuuuggaaaaguuguucacgggccccagcggugccuuuauuguccaaccacaaaaugguaggugcacgaccgauggcgugcucuuaggcaccacccaacugucuccugucaacaucugcaccuucagaggggaugucacccacauugcagguucucgcaauuacacgaugaauuuggcuucucuaaauuggaauaauuaugacccaacagaagaaauuccagccccucugggaacuccagauuucgugggaaagauccaaggugugcucacucaaaccacaaagggagauggcucgacccguggccauaaagcaacaguuuacacugggagugcccccuuuacuccaaagcugggcaguguucaauucaguacugacacagaaaaugauuuugaagcucaccaaaacacaaaauucaccccagucggugucauccaggaugguggcaccacccaccgaaaugaaccccaacaaugggugcucccaaguuauucagguagagauguccacaauguacaccuggccccugcuguagcccccacuuuuccgggugaacaacuucuuuucuucagguccacuaugcccggaugcaguggguaucccaacauggauuuggauugccuacucccucaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucauccccccuaauggcuauuuuagguuugauuccuggguuaaccaauucuauacacuugcccccaugggaaauggaacggggcguagacgugcuuuauaa

SEQ ID NO: 4701 - RNA, 1647 nt, Artificial Sequence
  capsid_protein_VP1__Norovirus__AII02812
augaagauggcgucgaaugacgccgcuccaucuaaugauggugccgccggccucgucccagagaucaacagugaggcaauggcgcuagagccaguggcgggugcagcgauagcagcaccccucacuggucagcaaaauauaauugaucccuggauuaugaauaauuuugugcaagcaccugguggugaguucacaguauccccuagaaauuccccuggugaaguucuucucaauuuggaauuggguccagaaauaaaucccuacuuggcccaucuugcuagaauguauaaugguuaugcagguggauuugaagugcaggugguccuagcuggaaaugcguuuacagcaggaaagauaaucuuugcagcuauucccccuaauuuuccaauugauaaucuaagugcagcacagaucacaauguguccacaugugauuguggauguuagacagcuggaaccagucaaccucccgaugccugacguucgcaauaacuuuuuccauuacaaucaggggucugauucgagauugcgccuaauugcaaugcuauauacaccucuuagggcaaauaacucuggggaugauguuuucacugugucuugcagagugcuaacuagaccuaguccugacuucucauuuaauuuccuugugccacccacuguggagucaaagacaaaacccuuuucccuccccauucugacuaucucugaaauguccaauucuagguucccaguaccaauugauucucugcacaccagcccuacugagaacauuguuguccagugccagaauggacgcgucacccuugauggugaguugaugggcaccacccaacuuuuaccuagccaaaucugugcuuucaggggcaugcucaccagaucaacaagcagggccagugaccaggccgauacagcaaccccuagauuguuuaauuauuauuggcauauacaauuggauaaccuaaauggaacuccuuaugacccugcagaagauauaccaggcccccuagggacaccagauuuccggggcaaagucuuuggcguggccagccagagaaauccugaugccacgacuagggcacaugaagcaaagauagacacaacaucuggccgcuucaccccaaaauuaggcucacuagagauuuccacugagucuggagauuuugaucaaaaccaaccaacaagauucaccccaguuggcauugggguugaccaugaggcagauuuucaacaauggacucuucccgacuaugcuggccaguucacccacaacaugaacuuagccccagcuguugcucccaacuucccuggugagcagcuccuuuucuuccgcucacaguugccaucuucuggugggcgguccaacgggauucuagacugccuggucccccaagaauggguacagcacuucuaccaagaaucagcccccucccaaacucaaguggcccugguuagguaugucaacccugacacugguagaguguuauuugaggccaagcugcacaaauuagguuucaugacuauagccaagaguggugacucuccaauaacuguccccccaaauggauacuucagguuugaaucuugggugaaccccuuuuauacacuugcccccaugggaacugggaaugggcguagaaggauucaauaa

SEQ ID NO: 4702 - RNA, 1623 nt, Artificial Sequence
  capsid_protein_VP1__Norovirus__AII02815
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuaggaauaauuuuguacaagccccugguggagaauucacaguauccccuagaaacgcuccaggugagauacuauggagcgcgcccuuaggcccugaucugaaucccuaccuaucccauuuggccagaauguauaaugguuaugcagguggcuuugaagugcaggugauccucgcggggaacgcguucaccgccggaaaaauuauauuugcagcaguuccaccaaauuuuccaacugaaggcuugagccccagccagguuacuauguucccccauauaauaguagauguuaggcaacuggaaccuguguugauccccuuaccugauguuaggaauaacuucuaucauuauaaucagucaaaugauuccaccauuaaauugauagcaaugcuguacacaccacuuagggcuaauaaugcuggggaagaugucuucacagucucuugucgaguucucacgaggccauccccugauuuugauuuuauauuuuuggugccacccacaguugagucaagaacuaaaccauuuacugucccaaucuuaacuguugaagaaaugaccaauucaagauuccccaucccuuuggaaaaguuguucacgggccccagcggugccuuuauuguucaaccacaaaaugguaggugcacgacugauggcgugcucuuaggcaccacccaacugucuccugucaacaucugcaccuucagaggggaugucacccacauugcagguucucgcgauuacacgaugaauuuggcuucucuaaauuggaauaauuaugacccaacagaagaaauuccagccccucugggaacuccagauuucgugggaaagauccaaggugugcucacucaaaccacaaagggagauggcucgacccguggccacaaagcaacaguuuacacugggagugcccccuucacuccaaagcugggcaguguucaauucaguacugacacagaaaaugauuuugaagcucaccaaaacacaaaauucaccccagucggugucauccaggauggugguaccacccaccgaaaugaaccccagcaaugggugcucccaaguuauucagguagagauguccacaauguacaccuggccccugcuguagcccccacuuuuccgggugaacaacuucucuucuucagguccacuaugcccggaugcaguggguauccuaacauggauuuggauugccuacucccucaggagugggugcagcacuucuaccaagaggcagcuccagcacaaucugauguggcucuauugagauuugugaauccagacacggguaggguccuguuugagugcaaacuucauaaaucagguuaugucacaguggcucacaccggccagcaugauuuggucauccccccuaauggcuauuuuagguuugauuccuggguuaaccaauucuacacacuugcccccaugggaaauggaacggggcguagacgugcuuuauaa

SEQ ID NO: 4703 - RNA, 1647 nt, Artificial Sequence
  capsid_protein_VP1__Norovirus__AII02818
augaagauggcgucgaaugacgccgcuccaucuaaugauggugccgccggccucgucccagagaucaacagugaggcaauggcgcuagagccaguggcgggugcagcgauagcagcaccccucaccggucagcaaaauauaauugaucccuggauuaugaauaauuuugugcaagcaccugguggugaguucacaguauccccuagaaauuccccuggugaaguucuucucaauuuggaauuggguccagaaauaaaucccuauuuggcccaucuugcuagaauguauaaugguuaugcagguggauuugaagugcaggugguccuagcuggaaaugcguuuacagcaggaaagauaaucuuugcagcuauucccccuaauuuuccaauugauaaucuaagugcagcacagaucacaauguguccacaugugauuguggauguuaggcagcuggaaccagucaaccucccgaugccugacguucgcaacaacuuuuuccauuacaaucaggggucugauucgagauugcgccuaauugcaaugcuauauacaccucuuagggcaaauaacucuggggaugauguuuucacugugucuuguagagugcuaacuagaccuaguccugacuucucauuuaauuuccuugugccacccacuguggagucaaagacaaaacccuuuucccuccccauuuugacuaucucugaaauguccaauucuagguucccaguaccaauugauucucugcacaccagcccuacugagaacauuguuguccagugccagaauggacgcgucacccuugauggugaguugaugggcaccacccaacuuuuaccuagccaaaucugugcuuucaggggcaugcucaccagaucaacaagcagggccagugaccaggccgauacaguaaccccuagauuauuuaauuauuauuggcauauacaauuggauaaccuaaauggaacuccuuaugacccugcagaagauauaccaggcccccuagggacaccagauuuccggggcaaagucuuuggcguggccagccagagaaauccugaugccacgacuagggcacaugaagcaaagauagacacaacaucuggccgcuucaccccaaaauuaggcucacuagagauuuccacugagucugaugauuuuuaucaaaaccaaccaacaagauucaccccaguuggcauugggguugaccaugaggcagacuuucaacaauggacucuucccgacuaugcuggccaguucacccacaacaugaaccuagccccagcuguugcucccaacuucccuggugagcagcuccuuuucuuccgcucacaguugccaucuucuggugggcgguccaacgggauucuagacugccuggucccccaagaauggguacagcacuucuaccaagaaucagcccccucccaaacucaaguggcccugguuagguaugucaacccugacacugguagaguguuauuugaggccaagcugcacaaauuagguuucaugacuauagccaaaaauggugacucuccaauaacuguccccccaaauggauacuuuagguuugaaucuugggugaaccccuuuuauacacuugcccccaugggaacugggaaugggcguagaaggauucaauaa

SEQ ID NO: 4704 - RNA, 1623 nt, Artificial Sequence
  capsid_protein_VP1__Norovirus__AII02821
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuaggaauaauuuuguacaagccccugguggagaauucacaguauccccuagaaacgcuccaggugaaauacuauggagcgcgcccuuaggcccugaucugaaucccuaccuaucccauuuggccagaauguauaaugguuaugcagguggcuuugaagugcaggugauccucgcggggaacgcguucaccgccgggaaaauuauauuugcagcaguuccaccaaauuuuccaacugaaggcuugagccccagccagguuacuauguucccccacauaauaguagauguuaggcaacuggaaccuguguugauccccuuaccugauguuaggaauaacuucuaucauuauaaucagucaaaugauucuaccauuaaauugauagcaaugcuguacacaccacuuagagcuaauaaugcuggggaagaugucuucacagucucuugucgaguccuuacgaggccauccccugacuuugauuuuauauuuuuggugccacccacaguugagucaagaacuaaaccauuuacugucccaaucuuaacuguugaagaaaugaccaauucaagauuccccaucccuuuggaaaaguuguucacgggccccagcggugccuuuauuguucaaccacaaaaugguagaugcacgacugauggcgugcucuuaggcaccacccaacugucuccugucaacaucugcaccuucagaggggaugucacccacauugcagguucucgcaauuacacgaugaauuuggcuucucuaaauuggaauaauuaugacccaacagaagaaauuccagccccucugggaacuccagauuucgugggaaagauccaaggugugcucacucaaaccacaaagggagauggcucgacccguggccauaaagcaacaguuuacacugggggugcccccuuuacuccaaagcugggcaguguucaauucaguacugacacagaaaaugauuuugaagcucaccaaaacacaaaauucaccccagucggugucauccaggaugguggcaccacccaccgaaaugaaccccaacaaugggugcucccaaguuauucagguagagauguccacaauguacaccuggccccugcuguagcccccacuuuuccgggugaacaacuucuuuucuucagguccacuaugcccggaugcaguggguaucccaacauggauuuggauugccuacucccucaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucauccccccuaauggcuauuuuagguuugacuccuggguuaaccaauucuacacacuugcccccaugggaaauggaacggggcguagacgugcuuuauaa

SEQ ID NO: 4705 - RNA, 1623 nt, Artificial Sequence; identical to SEQ ID NO: 4454
  capsid_protein_VP1__Norovirus__AII02824

SEQ ID NO: 4706 - RNA, 1623 nt, Artificial Sequence; identical to SEQ ID NO: 4483
  capsid_protein_VP1__Norovirus__AII02827

SEQ ID NO: 4707 - RNA, 1623 nt, Artificial Sequence; identical to SEQ ID NO: 4466
  capsid_protein_VP1__Norovirus__AII02830

SEQ ID NO: 4708 - RNA, 1623 nt, Artificial Sequence
  capsid_protein_VP1__Norovirus__AII02833
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuaggaauaauuuuguacaagccccugguggagaauucacaguauccccuagaaacgcuccaggugaaauacuauggagcgcgcccuuaggcccugaucugaaucccuaccuaucccauuuggccagaauguauaaugguuaugcagguggcuuugaagugcaggugauccucgcgggaaacgcguucaccgccggaaaaauuauauuugcagcaguuccaccaaauuuuccaacugaaggcuugagccccagccagguuacuauguucccccacauaauaguagauguuaggcaacuggaaccuguguugauccccuuaccugauguuaggaauaacuucuaucauuauaaucagucaaacgauucuaccauuaaauugauagcaaugcuguacacaccacuuagggcuaauaaugcuggggaagaugucuucacagucucuugucgaguccucacgaggccauccccugauuuugauuuuauauuuuuggugccacccacaguugagucaagaaccaaaccauuuacugucccaaucuuaacuguugaagaaaugaccaauucaagauuccccaucccuuuggaaaagcuguucacgggccccagcggugccuuuauuguccaaccacaaaaugguagaugcacgaccgauggcgugcucuuaggcaccacccaacugucuccugucaacaucugcaccuucagagggggugucacccacauugcagguucucgcaauuacacgaugaauuuggcuucucuaaauuggaauaauuaugacccaacagaagaaauuccagccccucugggaacuccagauuucgugggaaagauccaaggugugcucacucaaaccacaaagggagauggcucgacccguggccauaaagcaacaguuuacacugggagugcccccuuuacuccaaagcugggcaguguucaauucaguacugacacagaaaaugauuuugaagcucaccaaaacacaaaauucaccccagucggugucauccaggaugguggcaccacccaccgaaaugaaccccaacaaugggugcucccaaguuauucagguagagauguccacaauguacaccuggccccugcuguagcccccacuuuuccgggugaacaacuucuuuucuucagguccacuaugcccggaugcaguggguaucccaacauggauuuggauugccuacucccucaggagugggugcagcacuucuaccaagaggcagcuccagcacaaucugauguggcucuauugagauuugugaauccagacacggguaggguccuguuugagugcaaacuucauaaaucaggcuaugucacaguggcccacaccggccagcaugauuuggucauccccccuaauggcuauuuuagguuugauuccuggguuaaccaauucuauacacuugcccccaugggaaauggaacggggcguagacgugcuuuauaa

SEQ ID NO: 4709 - RNA, 1623 nt, Artificial Sequence
  capsid_protein_VP1__Norovirus__AII02836
augaagauggcgucgaaugacgccaacccaucugauggguccgcagccaaccucgucccagaggucagcaaugagguuauggcuuuggagcccguugccggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauuaauagcaaugcuguacacaccacuuagggccaauaacgcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugcuuuuguuguccaaccacaaaauggcaggugcacgacugauggcgugcucuuaggcaccacccaacugucucccgucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagagaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4710 - RNA, 1623 nt, Artificial Sequence; identical to SEQ ID NO: 4504
  capsid_protein_VP1__Norovirus__AII02839

SEQ ID NO: 4711 - RNA, 1623 nt, Artificial Sequence
  capsid_protein_VP1__Norovirus__AII02842
augaagauggcgucgaaugacgccaacccaucugauggguccgcagccaaccucgucccagaggucagcaaugagguuauggcuuuggagcccguugucggugccgcuauugcggcgccuguggcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaucuaucccauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaagaagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaaugugcaccuagccccugcuguggcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4712 - RNA, 1647 nt, Artificial Sequence
  capsid_protein_VP1__Norovirus__AII02845
augaagauggcgucgaaugacgccgcuccaucuaaugauggugccgccggccucgucccagagaucaacagugaggcaauggcgcuagagccaguggcgggugcagcgauagcagcaccccucacuggucagcaaaauauaauugaucccuggauuaugaauaauuuugugcaagcaccugguggugaguucacaguauccccuagaaauuccccuggugaaguucuucucaauuuggaauuggguccagaaauaaaucccuacuuggcccaucuugcuagaauguauaaugguuaugcagguggauuugaagugcaggugguccuagcuggaaaugcguuuacagcaggaaagauaaucuuugcagcuauucccccuaauuuuccaauugauaaucuaagugcagcacagaucacaauguguccacaugugauuguggauguuagacagcuggaaccagucaaccucccgaugccugacguucgcaauaacuuuuuccauuacaaucaggggucugauucgagauugcgccuaauugcaaugcuauacacaccucuuagggcaaauaacucuggggaugauguuuucacugugucuugcagagugcuaacuagaccuaguccugacuucucauuuaauuuccuugugccacccacuguggagucaaagacaaaacccuuuucccuccccauucugacuaucucugaaauguccaauucuagguucccaguaccaauugauucucugcacaccagcccuacugagaacauuguuguccagugccagaauggacgcgucacccuugauggugaguugaugggcaccacccaacuuuuaccuagccaaaucugugcuuucaggggcaugcucaccagaucaacaagcagggccagugaccaggccgauacagcaaccccuagauuguuuaauuauuauuggcauauacaauuggauaaccuaaauggaacuccuuaugacccugcagaagauauaccaggcccccuagggacaccagauuuccggggcaaagucuuuggcguggccagccagagaaauccugaugccacgacuagggcacaugaagcaaagauagacacaacaucuggccgcuucaccccaaaauuaggcucacuagagauuuccacugagucuggagauuuugaucaaaaccaaccaacaagauucaccccaguuggcauugggguugaccaugaggcagauuuucaacaauggacucuucccgacuaugcuggccaguucacccacaacaugaacuuagccccagcuguugcucccaacuucccuggugagcagcuccuuuucuuccgcucacaguugccaucuucuggugggcgguccaacgggauucuagacugccuggucccccaagaauggguacagcacuucuaccaagaaucagcccccucccaaacucaaguggcccugguuagguaugucaacccugacacugguagaguguuauuugaggccaagcugcacaaauuagguuucaugacuauagccaagaguggugacucuccaauaacuguccccccaaauggauacuucagguuugaaucuugggugaaccccuuuuauacacuugcccccaugggaacugggaaugggcguagaaggauccaauaa

SEQ ID NO: 4713 - RNA, 1647 nt, Artificial Sequence; identical to SEQ ID NO: 4687
  capsid_protein_VP1__Norovirus__AII02848

SEQ ID NO: 4714 - RNA, 1623 nt, Artificial Sequence; identical to SEQ ID NO: 4458
  capsid_protein_VP1__Norovirus__AII02851

SEQ ID NO: 4715 - RNA, 1623 nt, Artificial Sequence; identical to SEQ ID NO: 4481
  capsid_protein_VP1__Norovirus__AII02854

SEQ ID NO: 4716 - RNA, 1623 nt, Artificial Sequence
  capsid_protein_VP1__Norovirus__AII02857
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuaggaauaauuuuguacaagccccugguggagaauucacaguauccccuagaaacgcuccaggugaaauacuauggagcgcgcccuuaggcccugaucugaaucccuaccuaucccauuuggccagaauguauaauggcuaugcagguggcuuugaagugcaggugauccucgcggggaacgcguucaccgccggaaaaauuauauuugcagcaguuccaccaaauuuuccaacugaaggcuugagccccagccagguuacuauguucccccacauaauaguagauguuaggcaacuggaaccuguguugauccccuuaccugauguuaggaauaacuucuaucauuauaaucagucaaaugauucuaccauuaaauugauagcaaugcuguacacaccacuuagggcuaauaaugcuggggaagaugucuucacagucucuugucgaguccucacgaggccauccccugauuuugauuuuauauuuuuggugccacccacaguugagucaagaacuaaaccauuuacugucccaaucuuaacuguugaagaaaugaccaauucaagauuccccaucccuuuggaaaaguuguucacgggccccagcggugccuucauuguucaaccacaaaaugguagaugcacgaccgauggcgugcucuuaggcaccacccaacugucuccugucaacaucugcaccuucagaggggaugucacccacauugcagguucucgcaauuacacgaugaauuuggcuucucuaaauuggaauaauuaugacccaacagaagaaauuccagccccucugggaacuccagauuucgugggaaagauccaaggugugcucacucaaaccacaaagggagauggcucgacccguggccauaaagcaacaguuuacacugggagugcccccuuuacuccaaagcugggcaguguucaauucaguacugacacagaaaaugauuuugaagcucaccaaaacacaaaauucaccccagucggugucauccaggaugguggcaccacccaccgaaaugaaccccaacaaugggugcucccaaguuauucagguagagauguccacaauguacaccuggccccugcuguagcccccacuuuuccgggugaacaacuucuuuucuucagguccacuaugcccggaugcaguggguaucccaacauggauuuggauugccuacucccucaggagugggugcagcacuucuaccaagaggcagcuccagcacaaucugauguggcucuauugagauuugugaauccagacacggguaggguccuguuugagugcaaacuucauaaaccaggcuaugucacaguggcucacaccggccagcaugauuuggucauccccccuaauggcuauuuuagguuugauuccuggguuaaccaauucuacacacuugcccccaugggaaauggaacggggcguagacgugcuuuauaa

SEQ ID NO: 4717 - RNA, 1623 nt, Artificial Sequence; identical to SEQ ID NO: 4449
  capsid_protein_VP1__Norovirus__AII02860

SEQ ID NO: 4718 - RNA, 1623 nt, Artificial Sequence; identical to SEQ ID NO: 4452
  capsid_protein_VP1__Norovirus__AII02866

SEQ ID NO: 4719 - RNA, 1623 nt, Artificial Sequence
  capsid_protein_VP1__Norovirus__AII02869
augaagauggcgucgaaugacgccaacccaacugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaccccuaccuaucccauuuggccagaauguauaaugguuaugcaggugguuuugaagugcaggugauccucgcggggaacgcguucaccgccgggaaaauuauauuugcagcagucccaccaaauuuuccaacugaaggccugagucccagccaggucacuauguucccccacauaauaguagauguuaggcaauuagaaccuguguugauccccuuaccugauguuaggaauaacuucuaucacuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcacuacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacccaaaccacaaaaggagauggcucgacccguggccauaaagcuacaguuuacacugggagugcccccuuuaccccaaagcugggcaguguucaauucaguacugacacagaaaaugauuuugaaacucaccaaaacacaaaauucaccccagucggugucauccaggauggugguaccacccaccgaaaugaaccccaacaaugggugcucccaaguuauucagguagagauguucauaauguacaccuagccccugcuguggcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4720 - RNA, 1623 nt, Artificial Sequence
  capsid_protein_VP1__Norovirus__AII02872
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccuugcggggaacgcguucaccgccggaaaaauuauauuugcagcagucccaccaaacuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuucccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagcuccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauuuaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggauguagcggguaucccaacauggauuuggauugccuacucccccaggagugggugcagcacuucuaccaagaggcagcuccagcacagucugauguggcucuauugagauuugugaauccagacacggguaggguccuguuugagugcaaacuucauaaaucaggcuaugucacaguggcccacaccggucagcaugauuuggucaucccccccaauggcuauuuuagguuugauuccuggguuaaucaguucuacacacuugcccccaugggaaacggaacggggcguaggcgcgcuuuauaa

SEQ ID NO: 4721 - RNA, 1623 nt, Artificial Sequence
  capsid_protein_VP1__Norovirus__AII02875
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaccccuaccuaucccauuuggccagaauguauaaugguuaugcaggugguuuugaagugcaggugauccucgcggggaacgcguucaccgccggaaaaauaauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaaucuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuacuuuagguuugauuccuggguuaaucaguucuauacgcuugcccccaugggaaacggaacggggcguaggcgcgccuuauaa

SEQ ID NO: 4722 - RNA, 1647 nt, Artificial Sequence
  capsid_protein_VP1__Norovirus__AII02878
augaagauggcgucgaaugacgccgcuccaucuaaugauggugccgccggccucgucccagagaucaacagugaggcaauggcgcuagagccaguggcgggugcagcgauagcagcaccccucacuggucagcaaaauauaauugaucccuggauuaugaacaauuuugugcaagcaccugguggugaguucacaguauccccuagaaauuccccuggugaaguucuucucaauuuggaauuggguccagaaauaaaucccuacuuggcccaucuugcuagaauguauaaugguuaugcagguggauuugaagugcaggugguccuagcuggaaaugcguuuacagcaggaaagauaaucuuugcagcuauucccccuaauuuuccaauugauaaucuaagugcagcacagaucacaauguguccacaugugauuguggauguuagacagcuggaaccagucaaccucccgaugccugacguucgcaauaacuuuuuccauuacaaucaggggucugauucgagauugcgccuaauugcaaugcuauauacaccucuuagggcaaauaacucuggggaugauguuuucacugugucuugcagagugcuaacuagaccuaguccugacuucucauuuaauuuccuugugccacccacuguggagucaaagacaaaacccuuuucccuccccauucugacuaucucugaaauguccaauucuagguucccaguaccaauugauucucugcacaccagcccuacugagaacauuguuguccagugccagaauggacgcgucacccuugauggugaguugaugggcaccacccaacuuuuaccuagccaaaucugugcuuucaggggcaugcucaccagaucaacaagcagggccagugaccaggccgauacagcaaccccuagauuguuuaauuauuauuggcauauacaauuggauaaccuaaauggaacuccuuaugacccugcagaagauauaccaggcccccuagggacaccagauuuccggggcaaagucuuuggcguggccagccagagaaauccugaugccacgacuagggcacaugaagcaaagauagacacaacaucuggccgcuucaccccaaaauuaggcucacuagagauuuccacugagucuggagauuuugaucaaaaccaaccaacaagauucaccccaguuggcauugggguugaccaugaggcagauuuucaacaauggacucuucccgacuaugcuggccaguucacccacaacaugaacuuagccccagcuguugcucccaacuucccuggugagcagcuccuuuucuuccgcucacaguugccaucuucuggugggcgguccaacgggauucuagacugccuggucccccaagaauggguacagcacuucuaccaagaaucagcccccucccaaacucaaguggcccugguuagguaugucaacccugacacugguagaguguuauuugaggccaagcugcacaaauuagguuucaugacuauagccaagaguggugacucuccaauaacuguccccccaaauggauacuucagguuugaaucuugggugaaccccuuuuauacacuugcccccaugggaacugggaaugggcguagaaggauucaauaa

SEQ ID NO: 4723 - RNA, 1623 nt, Artificial Sequence
  capsid_protein_VP1__Norovirus__AII02881
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauucucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagacggcucgacccguggccauaaagcuacaguuuacacugggagugcccccuuuacuccaaagcuggguaguguucaauucaguacugacacagaaaaugauuuugaaacucaccaaaacacaaaauucaccccagucggugucauccaggaugguggcaccacccaccgaaaugaaccccaacagugggugcucccaaguuauucagguagagauguucauaaugugcaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4724 - RNA, 1623 nt, Artificial Sequence; identical to SEQ ID NO: 4464
  capsid_protein_VP1__Norovirus__AII02884

SEQ ID NO: 4725 - RNA, 1647 nt, Artificial Sequence; identical to SEQ ID NO: 4701
  capsid_protein_VP1__Norovirus__AII02887

SEQ ID NO: 4726 - RNA, 1623 nt, Artificial Sequence; identical to SEQ ID NO: 4507
  capsid_protein_VP1__Norovirus__AII02890

SEQ ID NO: 4727 - RNA, 1623 nt, Artificial Sequence
  capsid_protein_VP1__Norovirus__AII02893
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaacuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggcgcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4728 - RNA, 1623 nt, Artificial Sequence
  capsid_protein_VP1__Norovirus__AII02896
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucccauuuggccagaauguauaaugguuaugcaggugguuuugaagugcgggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucaaacaaaugauucuaccauuaaauugauagcaaugcuguauacuccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaauucaccaaaacacaaaauucaccccagucggugucauccaggaugguggcaccacccaccgaaaugaaccccaacaaugggugcucccaaguuauucagguagagauguucauaauguacaccuagccccugcuguggcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauagaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 4729 - RNA, 1647 nt, Artificial Sequence
  capsid_protein_VP1__Norovirus__AII02899
augaagauggcgucgaaugacgccgcuccaucuaaugauggugccgccggccucgucccagagaucaacagugaggcaauggcgcuagagccaguggcgggugcagcgauagcagcaccccucacuggucagcaaaauauaauugaucccuggauuaugaauaauuuugugcaagcaccugguggugaauucacaguauccccuagaaauuccccuggugaaguucuucucaauuuggaauuggguccagaaauaaaucccuacuuggcccaucuugcuagaauguauaaugguuaugcagguggauuugaagugcaggugguccuagcuggaaaugcguuuacagcaggaaagauaaucuuugcagccauucccccuaauuuuccaauugauaaucuaagugcagcacagaucacaaugugcccacaugugauuguggauguuagacagcuggaaccagucaaccucccgaugccugacguucgcaauaacuuuuuccauuacaaucaggggucugauucgagauugcgccuaauugcaaugcuguauacaccucuuagggcaaauaacucuggggaugauguuuucacugugucuugcagagugcuaacuagaccuaguccugacuucucauuuaauuuccuugugccacccacuguggagucaaagacaaaacccuuuucccuccccauucuaacuaucucugaaauguccaauucuagguucccaguaccaauugauucucugcacaccaguccuacugagaacauuguuguccagugccagaacggacgcgucacccuugauggugaguugaugggcaccacucaacuuuuaccuagccaaaucugugcuuucaggggcaugcuaaccagaucaacaagcagggccagugaccaggccgauacagcaaccccuagauuguuuaauuauuauuggcauauacaauuggauaaccuaaauggaacuccuuaugacccugcagaagauauaccaggcccccuagggacaccagauuuccggggcaaagucuuuggcguggccagccagagaaauccugaugccacgacuagggcacaugaagcaaagauagacacaacaucuggccgcuucacuccaaaauuaggcucacuagagauuuccacugaaucuggagauuuugaucaaagccaaccaacaagauucaccccaguuggcauugggguugaccaugaggcagauuuucaacaauggacucuucccgacuacgcuggccaguucacccacaacaugaacuuagccccagcuguugcucccaacuuccccggugagcagcuccuuuucuuucgcucacaguugccaucuucuggcgggcgguccaacgggauucuagacugccuggucccccaagaaugggugcagcacuucuaucaagaaucggcccccucccaaacucaaguggcccugguuagguaugucaacccugacacugguagaguguuauuugaggccaagcugcacaaauuagguuucaugacuauagccaagaguggugacucuccaauaacuguccccccaaauggauacuucagguuugaaucuugggugaaccccuuuuauacgcuugcccccaugggaacugggaaugggcguagaaggauucaauaa

SEQ ID NO: 4730 - RNA, 1623 nt, Artificial Sequence; identical to SEQ ID NO: 4486
  capsid_protein_VP1__Norovirus__AII02902

SEQ ID NO: 4731 - RNA, 1647 nt, Artificial Sequence
  capsid_protein_VP1__Norovirus__AIS24557
augaagauggcgucgaaugacgcugcuccaucuaaugauggugccgccggccucguaccagagaucaauaaugaggcaauggcgcuagauccaguggcgggcgcagcgauagcagcaccccuuacuggucagcaaaacauaauagaucccuggauuaugaauaauuuugugcaagcaccugguggugaguuuacagugucaccuaggaacuccccuggugaaguacuucuaaauuuagaauuaggcccagaaauaaaucccuaucuggcgcaucuugcuaggauguacaaugguuaugcagguggguuugaggugcaggugguccuggcuggaaaugcguuuacagcagggaaagugaucuuugcagcuauaccccccaauuucccaacugacaauuugagugcagcgcagauuacaauguguccucauguaauuguagaugucaggcaguuggaaccaaucaaccucccgaugccugauguccgcaacaauuucuuccauuauaaucaagguucugauucgagguuacgcuuaauugcaauguuguacacuccccuuagggcaaauaauucuggggaugauguuuucacugugucauguaggguguugacuaggcccaguccugacuucucauucaauuuccucgucccgcccacuguggaaucaaagacaaaaccuuucacccucccuauuuugaccaucucugagaugucuaauucuagauuuccagugccaauugacucucugcacaccaguccaacugauaacauuguuguccagugccaaaaugggcgcgucacccuugauggcgagcuaaugggcaccacccaacucuugccgagucagauaugugcuuuuaggggugugcucaccagaucaacaagcagggccagugaucaagcugacgcagcaaccccuagacucuucaacuacuauuggcacauacaacuagacaaccuaaaugggaccccguaugacccugcagaggacauaccagcuccucuggggacgccagacuuucggggcaaagucuuuggcguagccagccagagaaacccugacagcacaacaagggcacaugaggcaaaaguggauacaacaucuggccgcuucaccccaaaauugggcucccuagaaauauccacugaaucuggugacuuugaccagaaucaaccaacaagauucaccccaguuggcauuggaguugacaaugaggcagacuuucaacaauggaccuuacccgauuauuccggucaguucacccacaacaugaaucuggccccagcugucgcucccaauuuucccggugaacagcuucuuuucuuccgcucacaguugccauccucuggcgggcgguccaauggcauucuagacugccuggucccccaggaauggguccaacacuucuaccaggaauccgccccugcccaaacgcagguggcucuggucagguaugucaacccugauacugguaggguguuauuugaggcuaagcugcauaagcuaggcuacaugaccauagcuaagaguggugauucuccaauaacuguacccccaaauggauacuuuagguuugaaucuugggugaaucccuuuuacacauuagcccccaugggaacugggaaugggcguagaaggauucaauaa

SEQ ID NO: 4732 - RNA, 1620 nt, Artificial Sequence
  capsid_protein_VP1__Norovirus__AIY30135
augaggaugagugauggcgcagcgccaaaagccgacggcucugaagccagcggccaggaucuuguuccuaccgccguugagcaggccguccccauucagcccguggcuggcgcggcucuugccgcccccgccgccgggcaaauuaaccaaauugaccccuggaucuuccaaaauuuuguccaaugcccccuuggugaguuuuccauuucaccucgaaacaccccaggugaaauauuguuugauuuggcccucggaccagggcucaaccccuaccuugcccaccucucagccauguacaccggcuggguugggaacauggagguucagcugguccucgccggcaaugccuuuacugcuggcaaggugguuguugcccuuguaccacccuauuuucccaaagggucacucaccacugcucaaaucacaugcuucccacaugucaugugugaugugcgcacccuggagcccauucaauugccucuucuugacgugcgucgaguucuuuggcaugcuacccaggaucaggaggaaucuaugcgccugguuugcaugcuguacacgccacuccgcacaaacagcccgggugaugagucuuuuguggucucuggccgccuucuuucuaagccggcagcugauuucaacuuuguauaccugaccccccccauagagagaaccaucuaccggauggucgaccugcccgugauacagccgcggcugugcacgcacgcacguuggccugccccggucuauggccucuugguagacccaucccuucccucaaacccccaguggcagaauggaagagugcauguugauggaacccugcuuggcaccacuccggucucuggcucauggguguccugcuuugcggcagaggccgccuaugaguuccaaucaggcacgggucagguggcaacauucacccugaucgagcaagauggcucugccuauguucccggugacagggcagcgccacucgguuaccccgacuucuccgggcaacuggagaucgagguccaaaccgagaccaccaagacuggagacaagcucaagguuaccacuuuugagaugauccuuggcccaacaaccaacguggaucaggcccccuaccagggcaagguuuuugccagcaucaccgccgcggcaucccucgaucugguggacggcaggguucgcgcggucccaagguccauuuauggcuuccaggauguuaucccugaauacaaugaugggcuacugguuccucuugcccccccaauuggccccuuucuuccuggugagguucuccugagguuccggaccuauaugcgucagcuugacaccgcugaugccgcggcagaggcgauagacugugcacucccccaggaguuuaucucuugguucgcgucuaacguguucaccgugcagucugaagcccugcuucuuagguauaggaacacccugacugggcaauugcuguuugagugcaaacucuacagcgaggguuacaucgccuuguccuacucaggaucaggaccccucaccuucccgacugauggcuucuuugagguugucaguugggucccccgccuuuaucaauuggccucugugggaagcuuggcaacaggccgaacacucuaa

SEQ ID NO: 4733 - RNA, 1623 nt, Artificial Sequence
  capsid_protein_VP1__Norovirus__AKE07100
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguucacaauauccccuagaaacgcuccaggugaaauacuauggagcgcgcccuuaggcccugauuugaaucccuaccuuucccauuuggccagaauguacaaugguuaugcaggugguuuugaagugcagguaauccuugcggggaaugcguucaccgccggaaaagucauauuugcagcagucccaccaaauuucccaacugaaggcuugagccccagccaggucacuauguuuccccauauaguaguagauguuaggcaacuggagccuguguugauccccuuacccgauguuaggaauaauuucuaccacuacaaucaaucaaaugaccccaccaucaaauugauagcaauguuguauacaccacuuagggcuaacaaugcuggggacgaugucuucacaguuucuugucgcguucucacgagaccaucccccgacuuugauuucauauuucuagugccacccacaguugaaucaagaacuaaaccauucucuaucccaguuuuaacuauugaggagaugaccaauucaagauuccccauuccucuggaaaaguuguucacgggucccagcagcgccuuuguuguucaaccacaaaacggcaggugcucgacugauggcgugcuccuagguacuacccaacugucuccugucaacaucugcaccuucagaggggaugucacccacaucgcagguagccacaacuacacaaugaauuuggcuucucaaaauuggaacaguuaugauccaacggaagaaaucccagccccuuuaggaacuccagauuucgugggcaagauucaaggugugcucacccaaaccacaagggcagauggcucgacccgcggccacaaagcuacaguacucacugggagcgccaacuuuacuccaaagcuggguagaauucaauuugccacugacacagacaaugauuuugaaacuaaccaaaacacaaaauucaccccagucggugucauccaggauggugauacugcccaccgaaaugaaccccaacagugggugcucccaaguuacucagguagaaacacucauaaugugcaucuggcccccgcuguagcccccacuuuuccgggugaacaacuucuuuucuucagguccaccauacccggaugcagcggguaccccaauauggauuuggacugucugcucccccaggaaugggugcaguucuucuaccaagaggcagccccagcacaaucugauguggcucugcuaagauuugugaauccagacacagguaggguuuuguuugaaugcaagcuucauaaaucaggcuacauuacaguggcccacacaggccaacaugauuugguuaucccccccaaugguuauuuuagauuugauuccugggucaaccaguucuacacgcuugcccccaugggaaauggaacggggcguagacgugcauuauaa

SEQ ID NO: 4734 - RNA, 1623 nt, Artificial Sequence
  capsid_protein_VP1__Norovirus__AKE07103
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguguccccuaggaacgcuccaggugaaauacuauggagcgcgcccuuaggcccugaucuaaaccccuaccuaucccacuuggccagaauguacaaugguuaugcaggugguuuugaagugcaggugauccuugcggggaacgcguucaccgccgggaagaucauauuugcagcagucccaccaaauuucccaacugaaagcuugagccccagucaggucacuauguucccccauauaauaguagauguuaggcaacuagaaccuguguugauucccuuacccgauguuaggaacaauuucuaccauuauaaucaaucaaaugaccccacuaucaaguugauagcaauguuguacacaccacuuagggcuaauaaugcuggggacgaugucuucacaguuucuugccgaguucucacgaggccaucccccgauuuugacuucauauuuuuagugccacccacaguugagucaagaacuaaaccauucucugucccaauuuuaacuguugaggagaugaccaauucaagauuccccauuccuuuggaaaaguuguucacgggucccagcagugccuuuguuguucaaccacaaaacggcaggugcacgauugacggcgugcuccuagguacuacccaacugucuccugucaacaucugcaccuucagaggggaugucacucauauugcagguacucacaacuacacaaugaauuuggccacucaaaauuggaacaguuaugacccaacagaagaaaucccagccccucuaggaacuccagauuucguggggaagauucaagguguacucacccaaaccacaaagacagauggcucgacacgcggccacaaagcuacagugugcauugggagcgccgacuuugcuccaaaauuggguagaguucaauuugaaacugacacaaacaaugaucuugaaacuaaccaaaacacaaaguucaccccagucggugucauccagaauggugaaacugcccacaggaaugaaccccaacagugggugcucccgaguuacucaggcagaaauacucccaaugugcauuuggcccccgcuguagcccccacuuuuccgggugaacaacuucucuucuucagauccacuaugcccggaugcagcggguaucccaacauggauuuggacugccugcucccccaggaaugggugcaguacuucuaccaagaggcagccccagcacaaucugauguggcucuacuaagauuugugaacccagacacagguaggguuuuguuugaguguaagcuucauaaaucaggcuauguuacaguggcucacacugguucacaugauuugguuauccccccuaaugguuauuuuagguuugauuccugggucaaccaguucuacacacuugcccccaugggaaaugggacggggcguagacgugcaacauaa

SEQ ID NO: 4735 - RNA, 1623 nt, Artificial Sequence
  capsid_protein_VP1__Norovirus__AKE07106
augaagauggcgucgagugacgccaacccaucugauggguccacagccaaccucgucccagaggucaacgaugagguuauggcuuuggagcccguuguuggugccgcccuugcggcaccuguagcgggccaacaaaauguaauugaccccuggauuagaaacaauuuuguacaagccccugguggagaguucacaguauccccuagaaacgcuccaggugaaauacuauggagcgcgcccuuaggccccgauuugaaucccuaccuuucucauuuggccagaauguacaaugguuaugcaggugguuuugaagugcaggugauccucgcggggaaugcguucaccgccggaaaggucauauuugcagcagucccaccaaauuucccaacugaaggcuugagccccagccaggucacuauguucccccacauaauaguagauguuaggcaauuggaaccuguguugauccccuuacccgaugcuaggaauaauuucuaccacuacaaucaaucaaaugaauccaccaucaaauugauagcaauguuguauacaccacuuagggcuaacaaugcuggggacgaugucuucacagucucuugucgaguccucacgagaccaucccucgauuuugauuucauauuuuuagugccacccacaguugagucaagaacuaaaccauucucugucccaauuuuaacuguugaggaaaugaccaauucaagauuccccauuccuuuggaaagauuguucacgggucccagcagugccuuugccguucaaccacaaaacggcaggugcacgacugauggcgugcuccuagguacuacucaacugucuccugucaacaucugcaccuucagaggagaugucacccacaccacagguagucacaacuacacaaugaauuuggcuucccaaaaucggagcaauuaugacccaacagaagaaaucccagccccucuaggaacuccagacuucguggggaagauucaaggugcgcucacccaaaccacaagggcagauggcucgacccgcggccacaaagcuacaguguacacugggagcgccgacuuuacuccaaaacuggguagaguucaauuugccacugauacagaccaugauuuugauacuaaccaaaacacaaaguucaccccagucggugucauccaggaugguucuacuacccaccggaaugaaccccaacaaugggugcucccaaguuacucaggcagaaauacucauaaugugcaccuggcccccgcuguggcccccacuuuuccgggugaacagcuucucuucuuuagguccacuaugcccggauguaguggguaccccaacauggauuuggacugccugcucccccaagaauggguggcgcacuucuaccaagaggcagcccccgcacaaucugauguggcucugcuaagauuugugaauccagauacaggcaggguuuuguuugaguguaagcuucauaaaucaggcuauguuacaguggcucacacuggccaacaugauuugguuaucccccccaaugguuacuuuagauuugauuccugggucaaccaguucuacacacuugcccccaugggaaauggaacggggcguagacgugcauuguaa

SEQ ID NO: 4736 - RNA, 1719 nt, Artificial Sequence
  capsid_protein_VP1__Norovirus__ALQ12260
augaagauggcgucuaacggcgcugcggcuccaucucaggauggugcggccaaccucgucccagagagucaacaagagguuuuggccuuggaaccggucgccggagcagcccucgccgcuccuguggcuggacaguuuaaugccauugaccccuggauuaagcaaaauuuuguccaagccccagcuggggaguuuacagucucgccacgcaacgccccuggggaaguccuuauggaucucgagcuuggcccugaaaugaaccccuuccuagcacaccuagcccaaauguacaacgccuaugcuggagggauggaagugcagauuauucuugccgggaaugcguucaccgcggguaagauaauaguuugcgccgugccaccaaacuucccgccggaccggcugucagccucacaggccacaaacuucccacauguuaucauggacgucagaacauuggaaccagugguccucccccuuccugacguccgcgcugguuucuuccacuacaaccagcugagagaaccgcguaugcgacucaugacccuucuuuacacgccacuaagggccaauggaacuggggaugaugccuucaccgucucguguaggguucucacacgcccuaugcuggauuuugaguuuauguuucuugucccgcccacaguugaaucccgcgucacccccuuuucagucccaacuuauccuguaguggaaaugacaaacuccagauggccagccaggaucucaggcaugcaugucaacgcaaaccaaacccuggcuguucaauuccagaauggcaggugcacccuggauggccaacucauggguacuacacaacucugcgccgccgacguuugcaggaugagggggcgguacaccuccaccagggccgacccugccgggcugggcugggaccuggaugccaccacccuugucgacggcccggaggcgcgaguccaagccaggauaagugugucugcacaucuccaacuugaggaacugaguggccagccuuaugagguuuacggggagcaaccagcaccacuuggaaccccagacuuccaauguaggcugaugggggaacucguuaggcugccguccgccaacccgguggcccaaucgagguuccgugaugccuucuuugacaccuacggcgcccuuuucgcucccgcagucggcuccgugaccgucacagucaacaauagcuccagcucagacuucgccaacgaccagcccuuugaguucuugccaauuggcguugagauaggcaacuccgccagguacgacgaguuugcacugcccaguuacaacggggccauaggggaaaaccgccaucuugccccuaucgcagccccgggguucccuggugagaacuuaauuuucuuuuccuccaaccugccagugugggacuccaccucugcacaaagcaacagaagaaucucaugucuguugcccaaugaauucauacagcacuucuaugaucuccaggccccgucccaaucugauguggcccuccugagauacguccaucccgagacugaucgguuucuguuugagugcaagcuguacagagaugcuuuucuuacugucaauggagcgaguuacgcagaauucccagucaacggguauucuagauuugacucuugggugaaacaauucuucacacucagcccugugggaacuggcucuggccguagggggcgcucccguaaagcucaauaa

SEQ ID NO: 4737 - RNA, 1620 nt, Artificial Sequence
  capsid_protein_VP1__Norovirus__BAI49904
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaauuuacaguguccccuagaaacgcuccgggugagauacuauggagcgcgcccuugggcccugauuuaaaccccuaccuuucucauuuggccagaauguacaaugguuaugcaggugguuuugaagugcagguaauccucgcggggaacgcguucaccgccgggaaaaucauauuugcagcagucccaccaaauuuuccaacugaaggcuugagccccagccagguuacuauguucccccauauaauaguagauguuaggcaauuggaaccuguguugauccccuuaccugauguuaggaauaacuuuuaucauuacaaucaaucaaaugauucuaccauuaaauugauagcaaugcuguauacaccacuuagggcuaauaaugcuggagaugaugucuucacagucucuugucgaguccucacgaggccaucccccgauuuugauuucauauucuuggugccacccacaguugaaucaagaacuaaaccauuuaccgucccaaucuuaacuguugaggaaauguccaaaucaagauuccccauuccuuuggaaaaguuguacacgggucccagcagugcuuuuguuguccaaccacaaaauggcaggugcacgacugauggcgugcucuuaggcacuacccaacuaucuguugucaacaucugcaccuucagaggggaugucacccacauugcaggcagucacgacuauacaaugaauuuggcuucucaaaauuggaacaauuaugacccaacagaagaaaucccagccccucugggaaccccagauuucgugggaaagauccaaggcaugcucacccaaaccacaagagaggauggcucgacccgcgcccacaaagccacagugagcacugggaguguccacuuuacuccaaagcuggguaguguucaauacaccacugacacaaacaaugacuuucaaacuggccaaaacacgaaauucaccccagucggcgucauccaggacgguaauaaccaucaaaaugaaccccaacaauggguacucccaaacuacucagguagaacuggucauaaugugcaccuagcuccugccguugcccccacuuuuccgggagagcaacuucucuucuuuagguccacuaugcccggguguagcggguaucccaacaugaauuuggauugccuacucccccaggagugggugcagcacuucuaccaagaagcagccccagcacaaucugauguggcucugcugagauuugugaauccagacacagguagguuucuguuugagugcaagcuccauaaaucaggcuaugucacaguggcucacacaggcccgcaugauuuggucaucccccccaaugguuacuuuagauuugauuccugggucaaccaguucuacacacuugcccccaugggaaauggagcggggcgcagacguguauuauaa

SEQ ID NO: 4738 - RNA, 1623 nt, Artificial Sequence
  capsid_protein_VP1__Norovirus__BAI49905
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguuuccccauauaauaguagauguuaggcaauuggaaccuguguugauccccuuaccugauguuaggaauaauuucuaucacuacaaucaaucaaaugacuccaccauuaaauugauagcaaugcuguacacaccacuuagggcuaauaaugcuggggaugaugucuucacagucucuugucgaguccucacgagaccaucccccgauuuugauuuuauauuucugguaccacccacaguugagucaagaaccaaaccauucaccgucccaauuuuaacuguugaggaaaugaccaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggggaugucacccacauuccaaguacucguacuuacagaaugaauuuggcuucucaaaauuggaacaauuaugacccaacagaagaaaucccagccccucugggaacuccagauuucgugggaaagauccaaggcaugcucacccaaaccacaaagggagacggcucgacccgcggucacaaagcuacagugagcacugggagugucgacuucacuccaaagcugggcagcguucaguucgccacugauacagacaaugauuuugaaacuggccaaaacacaagguucaccccagucggugucauccaggaugguaguagugcccacagaaaugaaccccaacaauggguacucccagauuacucagguagaacuguucauaauguacaccuagccccugccguagcccccacuuucccgggugagcaacuucuuuucuucagaucuacuaugcccggaugcaguggguaucccaauauggauuuggauugucuacucccccaggaaugggugcagcacuucuaccaagaggcagcuccagcacaaucugauguggcuuugcugagauucgugaauccagacacagguaggguucuguuugagugcaagcuucauaaaacaggcuaugucacaguggcucacacuggccagcaugauuuggucaucccccccaauggcuacuuuagauuugauuccugggucaaccaguucuacacacuugcccccaugggaaauggagcggggcguagacgugcauuauaa

SEQ ID NO: 4739 - RNA, 1623 nt, Artificial Sequence
  capsid_protein_VP1__Norovirus__BAI49906
augaagauggcgucaaaugacgccagcccaucugauggguccacagccaaccucgucccagaggucaacaaugagguuauggcuuuggagcccguuguuggugccgcuauugcggcaccuguagcgggccaacaaaauguaauugaccccuggauuagaaauaauuuugugcaagccccugguggagaguucacaguguccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagucccaccaaauuuuccaacugaaggcuugagccccagccaagucacuauguucccccauauaauaguagauguuaggcaauuggaaccuguguugauccccuuaccugauguuaggaauaauuucuaccacuacaaucaaucaaaugacuccaccauuaaauugauagcaaugcuguacacaccacuuagggcuaauaaugcuggggaugaugucuucacagucucuugucgaguccucacgagaccaucccccgauuuugauuucauauuucuggugccacccacaguugagucaagaaccaaaccauucaccgucccaauuuuaacuguugaggaaaugaccaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggggaugucacccacauuccagguacucguacuuacagaaugaaucuggcuucucaaaauuggaacaauuaugacccaacagaagaaaucccagccccucugggaacuccagauuucgugggaaagauccaaggcaugcucacccaaaccacaaagggagacggcucgacccacggucacaaagcuacagugagcacugggagugucgacuucacuccaaagcugggcagcguucaguucgccacugauacagacaaugauuuugaaacuggccaaaacacaagguucaccccagucggugucauccaggaugguaguagugcccacagaaaugaaccccaacaauggguacucccagauuacucagguagaacuguucauaauguacaccuagccccugccguagcccccacuuuuccgggugagcaacuucuuuucuucagaucuacuaugcccggaugcaguggguaucccaauauggauuuggauugucuacucccccaggaaugggugcagcacuucuaccaagaggcagcuccagcacaaucugauguggcuuugcugagauucgugaauccagacacagguaggguucuguuugagugcaagcuucauaaaacaggcuaugucacaguggcucacacuggccagcaugauuuggucaucccccccaauggcuacuuuagauuugauuccugggucaaccaguucuacacacuugcccccaugggaaauggagcggggcguagacgugcauuguaa

SEQ ID NO: 4740 - RNA, 1623 nt, Artificial Sequence
  capsid_protein_VP1__Norovirus__BAI49907
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaauccauaccucucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaauuggaaccuguguugauccccuuaccugauguuaggaauaauuuuuaccacuacaaucaaucaaaugacuccaccauuaaauugauagcaaugcuguacacaccacuuagggcuaauaaugcuggggaugaugucuucacagucucuugucgaguccucacgagaccaucccccgauuuugauuucauauuuuuggugccacccacaguugagucaagaaccaaaccauucaccgucccaauuuuaacuguugaggaaaugaccaauucaagauuccccauuccuuuggaaaaauuguucacgggucccaguagugccuuugucguccaaccacaaaauggcaggugcacgacugauggcgugcucuuaggcacuacccaacugucccccgucaacaucugcaccuucagaggggaugucacccacauuccagguacucguacuuacagaaugaauuuggcuucucaaaauuggaacaauuaugacccaacagaagaaaucccagccccucugggaacuccagauuuugugggaaagauccaaggcgugcucacccagaccacaaggggagacggcucgacccgcggucacaaagcuacagugagcacugggagugucgacuucacuccaaagcugggcagcguucaguucgccacugauacagacaaugauuuugaaacuggccaaaacacaagguucaccccagucggugucauccaggaugguaguagugcccacagaaaugaaccccaacaauggguacucccagauuacucagguagaacuguucauaauguacaccuagccccugccguagcccccacuuuuccgggugagcaacuucuuuucuucagauuuacuaugcccggaugcaguggguaucccaauauggauuuggauugucuacucccccaggaaugggugcagcacuucuaccaagaggcagcuccagcacaaucugauguggcuuugcugagauuugugaauccagacacagguaggguucuguuugagugcaagcuucauaaaacaggcuaugucacaguggcucacacuggccagcaugauuuggucaucccccccaauggcuacuuuagauuugauuccugggucaaccaguucuacacacuugcccccauggggaauggagcggggcguagacgugcauuauaa

SEQ ID NO: 4741 - RNA, 1623 nt, Artificial Sequence
  capsid_protein_VP1__Norovirus__BAI49909
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaacguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugauccccuugccugauguuagaaauaauuucuaucauuauaaucaaucaaaugacuccaccaucaaauugauagcaaugcuguauacaccacuuagggcuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagauucccuauuccuuuggaaaaguuguucacgggucccagcagugccuuuguuguucaaccacaaaauggcagaugcacgacugauggcgugcucuuagguacuacccaacugucuccugucaacaucugcaccuucagaggggaugucacccacauugcagguacucaaaauuacacaaugaaucuggccucccaaaauuggaacaauuaugacccaacagaagaaaucccagccccucugggaaccccagauuuuguaggaaagauccaaggcgugcucacucaaaccacaaggagggauggcucgacccgcggucacaaagccacagugagcacuggaaguguccacuucaccccaaagcugggcaguguucaauucuccacugacacaagcaaugacuuugaaacuggccaaaacacgagauucaccccagucggugucguccaggaugguaguaccacccaucaaaaugaaccccaacaaugggugcucccaaacuauucagguagagauagucauaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguuuuguuugagugcaagcuucauaagucaggcuauguaacaguggcucacacuggucaacaugauuugguuaucccccccaauggcuauuuuagauuugauuccugggucaaccaauucuacacacuugcccccaugggaaauggagcggggcguagacgugcauuauaa

SEQ ID NO: 4742 - RNA, 1623 nt, Artificial Sequence
  capsid_protein_VP1__Norovirus__BAI49910
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugauccccuugccugauguuagaaauaauuucuaucauuauaaucaaucaaaugacuccaccaucaaauugauagcaaugcuguauacaccacuuagggcuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagauucccuauuccuuuggaaaaguuguucacgggucccagcagugccuuuguuguucaaccacaaaauggcagaugcacgacugauggcgugcucuuagguacuacccaacugucuccugucaacaucugcaccuucagaggggaugucacccacauugcagguacucaaaauuacacaaugaaucuggccucccaaaauuggaacaauuaugacccaacagaagaaaucccagccccucugggaaccccagauuuuguaggaaagauccaaggcgugcucacucaaaccacaaggagggauggcucgacccgcggucacaaagccacagugagcacuggaaguguccacuucaccccaaagcugggcaguguucaauucuccacugacacaagcaaugacuuugaaacuggccaaaacacgagauucaccccagucggugucguccaggaugguaguaccacccaucaaaaugaaccccaacaaugggugcucccaaacuauucagguagagauagucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguuuuguuugagugcgagcuucauaagucaggcuauguaacaguggcucacacuggccaacaugauuugguuaucccccccaauggcuauuuuagauuugauuccugggucaaccaauucuacacacuugcccccaugggaaauggagcggggcguagacgugcauuauaa

SEQ ID NO: 4743 - RNA, 1623 nt, Artificial Sequence
  capsid_protein_VP1__Norovirus__BAI49911
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaauccauaccucucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaauuggaaccuguguugauccccuuaccugauguuaggaauaauuuuuaccacuacaaucaaucaaaugacuccaccauuaaauugauagcaaugcuguacacaccacuuagggcuaauaaugcuggggaugaugucuucacagucucuugucgaguccucacgagaccaucccccgauuuugauuucauauuuuuggugccacccacaguugagucaagaaccaaaccauucaccgucccaauuuuaacuguugaggaaaugaccaauucaagauuccccauuccuuuggaaaaauuguucacgggucccaguagugccuuugucguccaaccacaaaauggcaggugcacgacugauggcgugcucuuaggcacuacccaacugucccccgucaacaucugcaccuucagaggggaugucacccacauuccagguacucguacuuacagaaugaauuuggcuucucaaaauuggaacaauuaugacccaacagaagaaaucccagccccucugggaacuccagauuuugugggaaagauccaaggcaugcucacccagaccacaaggggagacggcuugacccgcggucacaaagcuacagugagcacugggagugucgacuucacuccaaagcugggcagcguucaguucgccacugauacagacaaugacuuugaaacuggccaaaacacaagguucaccccagucggugucauccaggaugguaguagugcccacagaaaugaaccccaacaaugggugcucccagauuacucagguagaacuguucauaauguacaccuagccccugccguagcccccacuuuuccgggcgagcaacuucuuuucuucagaucuacuaugcccggaugcaguggguaucccaauauggauuuggauugucuacucccccaggaaugggugcagcacuucuaccaagaggcagcuccagcacaaucugauguggcuuugcugagauuuguggauccagacacagguaggguucuguuugagugcaagcuucauaaaacaggcuaugucacaguggcucacacuggccagcaugauuugguuaucccccccaauggcuacuuuagauuugauuccugggucaaccaguucuacacacuugcccccaugggaaauggagcggggcguagacgugcauuauaa

SEQ ID NO: 4744 - RNA, 1623 nt, Artificial Sequence
  capsid_protein_VP1__Norovirus__BAI49912
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuaggaauaauuuuguacaagccccugguggagaguucacaguauccccuagaaacgcuccaggugaaauacuauggagcgcgcccuuaggcccugaucugaacccauaccuuucucaccuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuagacaauuggaaccuguguugauccccuuaccugauguuaggaauaauuucuaccauuacaaucaaucaaaugacuccaccauuaaauugauagcaaugcuguacacaccacuuagggcuaauaaugcuggggaugaugucuucacagucucuugucgaguccucacgaggccaucccccgauuuugauuucauauuucuggugccacccacaguugagucaagaaccaaaccauucaccgucccaauuuuaacuguugaggaaaugaccaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggcgaugucacccacauuccaggcacucguacuuacagaaugaauuuggcuucucaaaauuggaacaauuaugacccaacagaagaaaucccagccccucugggaacuccagauuucgugggaaggauccaaggcaugcucacccaaaccacaaagggagacggcucgacccgcggucacaaagcuacagugagcacugggaguguugacuuuacuccaaagcugggcagcguucaguucgccacugauacagacaaugauuuugaaacuggccaaaacacaagguucaccccagucggugucauccaggaugguaguagugcccucagaaaugaaccccaacaauggguacucccagauuacucagguagaacuguucauaauguacaccuagccccugccguggcccucacuuuuccgggugagcaacuucuuuucuucagaucuacuaugcccggaugcaguggguaucccaauauggauuuggacugucuacucccccaggaaugggugcagcacuucuaccaagaggcagccccaucacaaucugauguggcuuugcugagauuugugaauccagacacagguaggguucuguuugagugcaagcuucauagagcaggcuaugucacaguggcucacacuggccagcaugacuugguuaucccccccaauggcuacuucagauuugauuccuggguuaaccaguucuacacacucgcccccaugggaaauggagcggggcguagacgugcauuauaa

SEQ ID NO: 4745 - RNA, 1623 nt, Artificial Sequence
  capsid_protein_VP1__Norovirus__BAI49914
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuaggaauaacuuuguacaagccccugguggagaguucacaguauccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccacauaauaguagauguuaggcaauuggaaccuguguugauccccuuaccugauguuaggaauaauuucuaccauuacaaucaaucaaaugacuccaccauuaaauugauagcaaugcuguacacaccacuuagggcuaauaaugcuggggaugaugucuucacagucucuugucgaguccucacgaggccaucccccgauuuugauuucauauuucuggugccacccacaguugagucaagaaccaaaccauucaccgucccaauuuuaacuguugaggaaaugaccaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggagaugucacccacauuccagguacucguacuuacagaaugaauuuggcuucucaaaauuggaacaauuaugacccaacagaagaaauuccagccccucugggaacuccagauuucgugggaaagauccaaggcaugcucacccaaaccacaaagggagacggcucgacccgcggucacaaagcuacagugagcacugggaguguugacuucacuccaaagcugggcagcguucaguucgccacugacacagacaaugauuuugaaacuggccaaaacacaagguucaccccagucggugucauccaggaugguaguaguacccacagaaaugaaccccaacaauggguacucccagauuacucagguagaacuguucauaauguacaccuggccccugccguagcccccacuuuuccgggugagcaacuucuuuucuucagaucuacuaugcccggaugcaguggguaucccaauauggauuuggauugucuacucccccaggaaugggugcagcacuucuaccaagaggcagccccaucacaaucugauguggcuuuguugagauuugugaauccagacacagguaggguucuguuugagugcaagcuucauaaagcaggcuaugucacaguggcucacacuggccagcaugauuuggucaucccccccaauggcuacuuuagauuugauuccugggucaaccaguucuacacacuugcccccaugggaaauggagcggggcguagacgugcauuauaa

SEQ ID NO: 4746 - RNA, 1623 nt, Artificial Sequence
  capsid_protein_VP1__Norovirus__BAI49916
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaauuuuuaucacuauaaucagucaaaugauucuaccauuaaauugauagcaaugcuguauacaccacuuagggcuaauaaugcuggggaagaugucuucacagucuccugucgaguccucacgaggccauccccugauuuugacuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaagguuugcucacucaaaccacaaagggagauggcucgacccguggccauaaagcuacaguuuacacugggagugcccccuuuacuccaaagcugggcgguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcgcagacgugcuuuauaa

SEQ ID NO: 4747 - RNA, 1623 nt, Artificial Sequence
  capsid_protein_VP1__Norovirus__BAI49917
augaagauggcgucgaaugacgccaacccaucugauggguccgcagccaaccucgucccagaggucaacaaugagguuauggcucuggagcccguugucggugccgcuauugcggcgccuguagcgggccaacaaaauguaauugaccccuggauuagaaauaauuuuguacaggccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccauauaauaguagauguuaggcaauuggagccuguguugauccccuuaccugauguuaggaauaacuucuaucacuauaaucagucaaaugauucuaccauuaaauugauagcaaugcuguacacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaagugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcaggcacucguaauuacacaaugaauuuggcuucucuaaauuggaacaauuacgacccaacagaagaaauuccagccccucuaggaacuccagauuucgugggaaagauccaaggugugcucacucaaaccacaaagggggauggcucgacccguggccauaaagcuacaguuuacacugggagugcccccuuuacuccaaagcugggcaguguucaauucaguacugauacagaaaaugauuuugaaacucaccaaaacacaaaguucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuaaugagauuugugaauccagacacggguagaguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 4748 - RNA, 1623 nt, Artificial Sequence
  capsid_protein_VP1__Norovirus__BAI49918
augaagauggcgucgaaugacgccaacccaucugauggguccgcagccaaccucgucccagaggucaacaaugagguuauggcucuggagcccguugccggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggagccuguguugauccccuuaccugauguuaggaauaacuucuaucacuauaaucagucaaaugauucuaccauuaaauugauagcaaugcuguacacaccacuuagggcuaauaaugcuggggaagaugucuucacagucucuugucgaguccucacgaggccauccccugauuuugauuuuauauuuuuggugccaccuacaguugagucaagaaccaaaccauuuacugucccaaucuuaacuguugaagaaaugaccaauucaagauuccccauuccuuuggaaaaguuguucacgggucccagcggugccuuuguuguucaaccacaaaauggcagaugcacuacugauggcgugcucuuaggcaccacccaacugucuccugucaacaucugcaccuucagaggggaugucacccacauugcaggcacucguaauuacacaaugaauuuggcuucucuaaauuggaacaacuacgacccaacagaagaaauuccagccccucuaggaacuccagauuucgugggaaagauccaaggugugcucacucaaaccacaaagggggauggcucgacccguggccauaaagcuacaguuuacacugggagugcccccuuuacuccaaagcugggcaguguucaauucaguacugauacagaaaaugauuuugagacucaccaaaacacaaaguucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggacuuggauugccuacucccccaggagugggugcagcacuucuaccaagaggcagcuccagcacaaucugauguggcucuaaugagauuugugaauccagacacggguagaguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 4749 - RNA, 1623 nt, Artificial Sequence
  capsid_protein_VP1__Norovirus__BAI49919
augaagauggcgucgaaugacgccaacccaucugauggguccgcagccaaccucgucccagaggucaacaaugagguuauggcucuggagcccguugucggugccgcuauugcggcgccuguagcgggccaacaaaauauaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggagccuguguugauccccuuaccugauguuaggaauaacuucuaucacuauaaucagucaaaugauucuaccauuaaauugauagcaaugcuguacacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcaggcacucguaauuacacaaugaauuuggcuucucuaaauuggaacaauuacgacccaacagaagaaauuccagccccucuaggaacuccagauuucgugggaaagauccaaggugugcucacucaaaccacaaagggggauggcucgacccguggccauaaagcuacaguuuacacuggaagugcccccuuuacuccaaagcugggcaguguucaauucaguacugauacagaaaaugauuuugaaacucaccaaaacacaaaguucaccccagucggugucauccaggaugguggcaccacccaccgaaaugaaccccaacaaugggugcucccaaguuauucagguagaaauguccauaauguacaccuagcccccgcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcccuaaugagauuugugaauccagauacggguagaguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 4750 - RNA, 1623 nt, Artificial Sequence
  capsid_protein_VP1__Norovirus__BAI49920
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggcuagaauguauaaugguuaugcaggugguuuugaagugcaggugauccucgcggggaacgcguucaccgccggaaaaauuauauucgcagcagucccaccaaauuuuccaacugaaggcuugagucccagccaggucacuauguucccccacauaauaguagauguuaggcaauuggaaccuguguugauccccuuaccugauguuaggaauaauuucuaucacuauaaucaguuaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagguuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugacuuugaaacucaccaaaacacaaaauucaccccagucggugucauccaggaugguagcaccacccaccggaaugaaccccaacaaugggugcucccaaguuauucagguagaaauguccauaauguacaccuagccccugcuguagcccccacuuuuccgggugaacagcuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 4751 - RNA, 1623 nt, Artificial Sequence
  capsid_protein_VP1__Norovirus__BAI49921
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggcgagauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccaggucacuauguucccccacauaauaauagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccaucccuugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggcgccuuuguuguucaaccacaaaauggcagaugcacgacugauggcgugcucuuaggcaccacccaacugucuccugucaacaucugcacccucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaucgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcaacacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguucgauuccuggguuaaucaauucuacacacuugcccccaugggaaauggaacggggcguagacgugcuuuguaa

SEQ ID NO: 4752 - RNA, 1623 nt, Artificial Sequence
  capsid_protein_VP1__Norovirus__BAI49923
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaagcugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaccccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 4753 - RNA, 1623 nt, Artificial Sequence
  capsid_protein_VP1__Norovirus__BAI49924
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauucccuuggaaaaauuguucacgggucccagcagugccuuuguuguucaaccacaaaauggcagaugcacgacugauggcgugcucuugggcaccacccaacugucuccugucaacaucugcaccuucagaggggaugucacccacauugcagguucucguaauuacauaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaagauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguguuuuauaa

SEQ ID NO: 4754 - RNA, 1623 nt, Artificial Sequence
  capsid_protein_VP1__Norovirus__BAI49925
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaagcgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauucccuuggaaaaauuguucacgggucccagcagugccuuuguuguucaaccacaaaauggcagaugcacgacugauggcgugcucuugggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaagauucaccccagucggugucauccaggaugguggcaccacccaccgaaaugaaccccaacagugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguguuuuauaa

SEQ ID NO: 4755 - RNA, 1623 nt, Artificial Sequence
  capsid_protein_VP1__Norovirus__BAI49926
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggcuugagucccagccaagucacuauguucccccacauaauaguagauguuaggcaauuggaaccuguguugauccccuuaccugauguuaggaauaauuucuaucacuauaaucagucaaaugauucuaccauuaaauugauagcaaugcuguauacaccacuuagggcuaauaaugcuggggaagaugucuucacagucucuugucgaguccucacgaggccauccccugauuuugacuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuugacuucucuaaauuggaacaauuaugacccaacagaagaaauuccagccccucuaggaacuccagauuucgugggaaagauccaagguuugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguauaaauguucauaauguacaccuagccccugcuguagcccccacuuuuccgggugaacaacuucuuuucuucagguccacuaugcccgggugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucacaaaucaggcuaugucacaguggcucacaccggccagcaugauuuggucaucccccccaauggcuauuuuagguuugauuccuggguuaaucaauucuacacacuugcccccaugggaaauggaacggggcgcagacgugcuuuauaa

SEQ ID NO: 4756 - RNA, 1623 nt, Artificial Sequence
  capsid_protein_VP1__Norovirus__BAI49927
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguauacaccacuuagggccaauaaugcuggggaagaugucuucacagucucuugucgaguccucacgagaccguccccugauuuugauuuuauauuuuuggugccacccacaguugagucaagaacuaaaccauuuacugucccaaucuuaacuguugaagaaaugaccaauucaagauuccccauuccuuuagaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaacuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuucacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcucacaccggccagcaugauuuggucaucccccccaauggcuauuuuagguuugauuccugggucaaucaauucuacacacuugcccccaugggaaauggaacggggcguagacgugcuuuauaa

SEQ ID NO: 4757 - RNA, 1623 nt, Artificial Sequence
  capsid_protein_VP1__Norovirus__BAI49928
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcaguuccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccucauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucccuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 4758 - RNA, 1620 nt, Artificial Sequence
  capsid_protein_VP1__Norovirus__BAJ25070
augaagauggcgucgagugacgccgcuccaucuaaugauggugcuacaggucucguaccagagaucaacacugagaccuugccccuugaacccguggccggagcggcaauugcugccccugucacgggccagaauaauauaauugaucccuggauuagaaauaauuuugugcaggcaccuaauggugaguuuacaguuucuccaagaaauuccccuggugaaauauuaaugaauuuggaauuagguccagaccucaauccauaccuggcucaccucucaagaauguacaauggcuaugcuggagguguugaagugcaagugcuccuagcugggaaugcguucacggcaggaaagauccucuuugcagcaguccccccaaauuuucccguugauaugcuuagccccgcucaaauuacaaugcuuccccauuugauuguagauguuaggacuuuggagcccaucaugauuccuuugcccgauguuaggaauguguucuaucauuauaauaaccaaccugccccacgaaugagauuaguugccaugcucuacaccccucugagguccaacggguccggagaagauguguucacugucuccugcaggguguuaaccagacccacaccggacuucgaguucacauaccuagucccccccucaguggaguccaaaaccaagccuuucucccuacccaucuuaacaauuggagaguuaacaaauucuagauucccagccccaauugaccaauuguuuacuucaaccaauaaugauguaguuguccaaccccaaaauggucgaugcacacuggacggugaacuacaaggcacaacacaacuuuugucaacagcaauaugcucauauagaggcacaacaucaaaccccauugacgauugggaugaucaccuccugcaccugacucaccccaauggagcaacauaugacccaacugaggacgugccugcucccuuuggcacgcaggacuuccagggcauucuguaugggauguugacucaaaacccccaaaccggggguggcgaagccgccaacucccggggggucuacaucucuuccaccagugacaaguucacccccaaauugggcacaauugguuugcaccacgugcaagguggcgauguagccaacaaccaaaagucaaaauuuacgcccauagggauagcagagaaugguaauaccccuuucagacaauggguacucccaaacuacucugguagacucacccucaacacaaaccucgcaccagcaguugggcccaacuucccuggggaacaaauccuuuucuucaggucaaaugucccaaguguccaagguggccauucuauagaaauugauuguuugaucccacaagaauggauuucccauuucuaccaagagucggcccccucccagagugauguagccuugaucagguaugucaacccugacacgggacgcacacucuuugaggccaaauugcauagacaaggguucaucaccauagcgaccacuggaaacaaccccguggucgugcccccuaacggguacuucagauuugauucuuggguuaaucaguuuuaugcacucgcccccaugggaacugggaaugggcgcagaaggguucaauaa

SEQ ID NO: 4759 - RNA, 1620 nt, Artificial Sequence
  capsid_protein_VP1__Norovirus__BAJ25072
augaagauggcgucgaaugacgccgcuccaucuaaugauggugcuacaggucucguaccagagaucaacacugagaccuugccccuugagcccguggccggagcggcaauugcugccccuguuacgggccagaauaauauaauugaucccuggauuagaacuaauuuugugcaggcuccuaauggugaguuuacaguuucuccaagaaauuccccuggugaaauauuaaugaauuuggaauuaggcccagaccucaauccauaucuggcucaccucgcaagaauguauaauggcuaugcuggagguguugaagugcaagugcuccuagcugggaacgcguucacggcaggaaagauccucuuugcagcaguccccccaaauuuucccguugacaugcuuagccccgcucaaaucacaaugcuuccccauuugauuguagauguuaggacuuuggagcccaucaugauuccuuugcccgauguuaggaauguguucuaccauuauaauaaccaaccugccccacgaaugagauuaguugccaugcucuacaccccucugagguccaacggguccggagaagauguguucacugucuccuguaggguguuaaccagacccacaccggacuucgaguucacauaccuagucccccccucaguggagucuaaaaccaagccuuucucccuacccaucuuaacaauuggagaguuaacaaauucuagauucccagccccgauugaccaauuguuuacuucaaccaauaaugauguaguuguccaaccccaaaauggucgaugcacacuggacggugaacuacagggcacaacacaacuuuugucaacagcagugugcucauauagaggcacaacaucaaaccccauugaugauugggaugaucaccuccugcaccugacucaccccaauggagcaacauaugacccaacugaggacgugccugcucccuuuggcacgcaggacuuucagggcauucuguaugggauguugacucaaaacccccaagccggggguggcgaagccgccagcucccggggggucuacaucucuuccaccagugacaaguucacccccaaauugggcacaauuggucugcaccgcgugcaagguggcgcuguagccgacaaucaaaagucaaaauuuacgcccauagggauagcagagaaugacaacaccccuuucagacaauggguacucccaaacuacucugguagacucacccucaacacaaaccucgcaccagcaguugggcccaacuucccuggggaacaaauccuuuucuucaggucaaaugucccaaguguccaagguggccauuccauagaaauugauugucugaucccacaagaauggguuucccauuucuaucaagagucagcccccucccagagugauguagccuugaucagguaugucaacccugacacaggacgcacacuuuuugaggccaaauugcauagacaaggguucaucaccauagcgaccacuggaaacaaccccguggucgugccccccaacggguacuucagauuugauucuuggguuaaucaguuuuaugcacucgcccccaugggaacugggaaugggcgcagaaggguucaauaa

SEQ ID NO: 4760 - RNA, 1608 nt, Artificial Sequence
  capsid_protein_VP1__Norovirus__BAJ25076
augaagauggcgucgaaugacgcuaauccguccagugacggaucagccaaccucgucccagagaucaguaaugagguuauggcccuugaaccaguagcuggugcugcuauugcugccccaguugcuggacaacaaaacauaauagaucccuggauuagaaacaauuuuguacaggccccugguggugaauucacuguuucaccaagaaacgccccgggggaaguacuucuaaauuuacccuugagcccugacaucaauccauauuuggcccaucuguccagaauguacaacgguuacgcuggaggcguggagguggaggugguccucgccgggaaugcguucacggcgggaaaaaucaucuuugccgcagugccaccaaauuuuccuccugagaaccuuagcccaagucaaauaacaauguuaccccacaucauaguugaugucaggcaauuggagccagugcgcauaccccuaccagaugugcgcaacaauuuuuaccacuacucuagagagaaugacuccacauugagguugauugcaauguuguauacuccccucagggccaauaaugcuggugaugauguguucacuguuucuugcaggguguugacaaggcccucucccgauuuugauuuuauauuccuggugccacccacaguugaaucuaaaucuaaacccuucaccauuccaaugcucaccauugaggagaugacuaauucuagguucccugccccauuagaacugaugaccacggggccgagucacgacauuguugugcagccgcaaaacggacgcugcaccaucgaugguguguuacucggcaccacacaguuguccccagucaacauuugcucucugaggggcguccccaccaagcgaaccaauggaaaugacaacuguuuugugcaacuugaaaacccuaaugguucagcuuacgacccaacagaggacauaccugcuguuuuggggucaccugauuuugugggagagcucuacgggacgaucacucagaggagcucggauaacucaacuagagcccacccuuuuacccucaacacuggaagcccuagguauacucccaagauuggcucaguggacauccgcgucacagacguuagugaccuccaagaccaugauccagugaaacucacuccaguuggccucucuggggacagagguucgauucaucaguggcaacuuccaaauuauucaggaguagcaacccauaacaugcauuuggccccauccguugcuccauuguuuccuggugaacagauucuuuucuuccgguccacaguccccgggugcggugguuauccaaacucaaacaucgauugcuugauuccucaggaguggguccaacauuucuaucaggagggugccccagcccgcaccgauguggccuugcucagauucauaaacccugacacgggcaggguacucuuugagugcaaauugcauaaacauggcuuuauuacuguggcuuacucuggaaaucaugaucuggucaugcccccaaauggcuauuuuagauuugaaucuugggugaaucaauuucacacucuugcccccaugggaacaggcucgggcagaaggaggauccaguaa

SEQ ID NO: 4761 - RNA, 1644 nt, Artificial Sequence
  capsid_protein_VP1__Norovirus__BAN16283
augaagauggcgucgagugacgcugcuccaucgaaugauggugcugccaaccucguaccagaggccaacaaugagguuauggcacuugaaccgguggugggagccucaaucgcagcuccugucgucggccaacaaaacauaauugaccccuggauuagagaaaauuuuguccaagcaccacagggcgaguucaccgucucaccgaggaacucgccuggugagaugcuauuaaaucuugaauugggcccagaacucaacccuuaccuaagucaccugucccgcauguauaauggguaugcugguggcaugcagguucaggugguccuagcugggaaugcguucacagcugggaaaaucaucuuugccgccguaccaccacauuuucccguagaaaacaucagugcagcucaaauaacuaugugcccccauguaauugucgaugugagacaacuugaaccaguacuucugccccuuccugacauaaggaacagguucuuucauuacaaucaggagaacaccccccggaugagacuuguggcuaugcuuuacaccccccugagggccaauucuggugaagacguguuuaccguuucuuguagggucuugacccguccugccccugauuuugaauuuacuuucuugguaccaccaacuguugaaucaaagacuaagcccuucacacugcccauauuaacucuuggugagcuaucuaacucgagauucccagccccaauagauauguuguacacugacccaaaugagggaauugugguccaaccacaaaaugguaggugcacucuugauggcacucugcaaggcaccacacaacugguccccacccaaauuugugcuuucaggggcacacuaauuggccaaacaucaagaucuucagauucaaccgacucagccccucggagaagggaucacccacuccaugugcaauuaaagaaccuugauggcacgcaguacgacccaacugaugaagugccagcaguccuuggugccauugacuucaaggggacugucuuugggguggccagucagagagaugugucaggggaucaagugggagcaacucgagcucaugaagugcacaucaacacaaccgauccuagguauacaccaaaacugggauccauucucaugcacucagagucgggcgacuuugugacuggacagccgguccgcuucacacccauaggaaugggugacaacgacuggcaccagugggagcugccugacuacucuggacaccuaacccugaacaugaaccuugccccagcagucgcuccugcuuuuccgggcgagaggauucuuuucuucaggucaauagucccgucugcugguggcuaugggacuggacaaauagauugccucauaccacaggaguggguucagcauuucuaccaggaagcugcaccaucccaaucugccguggcacucauuagguaugucaauccugacacaggcagaaacaucuuugaggcuaaauugcacagggaagguuucaucaccguggcaaauucugguaacaaccccauuguuguccccccuaauggguauuuuagguuugaggcuugggugaaucaauuuuacacuuugacccccaugggaacuggucaggggcguaggaggaaucaauaa

SEQ ID NO: 4762 - RNA, 1644 nt, Artificial Sequence
  capsid_protein_VP1__Norovirus__BAN16285
augaagauggcgucgaaugacgcugcuccaucgaaugauggugcugccaaccucguaccagaggccaacaaugagguuauggcacuugaaccgguggugggagccucaaucgcagcuccugucgucggccaacaaaacauaauugaccccuggauuagagaaaauuuuguucaagcaccacagggcgaguucaccgucucaccgaggaacucgccuggugagaugcuauuaaaucuugaauugggcccagaacucaacccuuaccuaagucaccugucccguauguauaauggguaugcugguggcaugcagguucaggugguccuagcugggaaugcguucacagcugggaaaaucaucuuugccgccguaccaccacauuuucccguggaaaacauuagugcagcucaaauaacuaugugcccccauguaauuguugaugugagacaacuugaaccaguacuucugccccuuccugacauaaggaauagguucuuucauuacaaucaggagaacaccccccggaugagacuuguggcuaugcuuuacaccccccugagggccaacucuggugaagauguguuuacugucucuuguagggucuugacccguccugccccugauuuugaauuuacuuucuugguaccaccaacugucgaaucaaagacuaaaccuuucacacugcccauauuaacucuuggugagcuaucuaacuccagauucccagccccaauagauauguuguacacugacccaaaugagggaauugugguccaaccacaaaaugguaggugcacucuugauggcacucugcaaggcaccacacaacugguccccacccaaauuugugcuuucaggggcacacuaauuggccaaacaucaagaucuucagacucaaccgacucagccccucggagaagggaucacccacuccaugugcaauuaaagaaccuugauggcacgcaguacgacccaacugaugaagugccagcaguccuuggugccauugacuucaaggggacugucuuugggguggccagucagagagacgugucagggcaacaagugggagcaacucgagcccaugaagugcacaucaacacaaccgauccuagguauacaccaaaacugggauccauucucaugcacucagagucggacgacuuugugacuggacagccgguccgcuucacacccauaggaaugggugacaacgacuggcaccagugggagcugccugacuacucuggacaccuaacccugaacaugaaccucgccccagcagucgcuccugcuuuuccgggcgagaggauucuuuucuucaggucaaugguuccgucugcugguggcuaugggucuggacaaauagauugccucauaccacaggaguggguucagcauuucuaccaggaagcugcaccaucccaaucugccguggcacucauuagguaugucaauccagacacaggcagaaacaucuuugaggcuaaauugcacagggaagguuucaucaccguggcaaauucugguaacaaccccauuguuguccccccuaauggguauuuuagguuugaggcuugggugaaucaauuuuacacuuugacccccaugggaacuggucaggggcguaggaggaaucaguaa

SEQ ID NO: 4763 - RNA, 1644 nt, Artificial Sequence
  capsid_protein_VP1__Norovirus__BAN16287
augaagauggcgucgaaugacgcugcuccaucgaaugauggugcugccaaccucguaccagaggccaacaaugagguuauggcacuugaaccgguggcgggagccucaaucgcagcuccugucgucggccaacaaaacauaauugaccccuggauuagagaaaauuuuguucaagcaccacagggcgaguucaccgucucaccgaggaacucgccuggugagaugcuauuaaaucuugaauugggcccagaacucaacccuuaccuaagucaccugucccguauguauaauggguaugcugguggcaugcagguucaggugguccuagcugggaaugcguucacagcugggaaaaucaucuuugccgccguaccaccacauuuucccgugaaaaacauuagugcagcucaaauaacuaugugcccccauguaauuguugaugugagacaacuugaaccaguacuucugccccuuccugacauaaggaauagguucuuucauuacaaucaggagaacaccccccggaugagacuuguggcuaugcuuuacaccccccugagggccaacucuggugaagauguguuuacugucucuuguagggucuugacccguccugccccugauuuugaauuuacuuucuugguaccaccaacugucgaaucaaagacuaaaccuuucacacugcccauauuaacucuuggugagcuaucuaacuccagauucccagccccaauagauauguuguacacugacccaaaugagggaauugugguccaaccacaaaaugguaggugcacucuugauggcacucugcaaggcaccacacaacugguccccacccaaauuugugcuuucaggggcacacuaauuggccaaacaucaagaucuucagacucaaccgacucagccccucggagaagggaucacccacuccaugugcaauuaaagaaccuugauggcacgcaguacgacccaacugaugaagugccagcaguccuuggugccauugacuucaaggggacugucuuugggguggccagucagagagacgugucagggcaacaagugggagcaacucgagcccaugaagugcacaucaacacaaccgauccuagguauacaccaaaacugggauccauucucauacacucagagucggacgacuuugugacuggacagccgguccgcuucacacccauaggaaugggugacaacgacuggcaccagugggagcugccugacuacucuggacaccuaacccugaacaugaaccucgccccagcagucgcuccugcuuuuccgggcgagaggauucuuuucuucaggucaaugguuccgucugcugguggcuaugggucuggacaaauagauugccucauaccacaggaguggguucagcauuucuaccaggaagcugcaccaucccaaucugccguggcacucauuagguaugucaauccagacacaggcagaaacaucuuugaggcuaaauugcacagggaagguuucaucaccguggcaaauucugguaacaaccccauuguugucccccauaauggguauuuuagguuugaggcuugggugaaucaguuuuacacuuugacccccaugggaacuggucaggggcguaggaggaaucaguaa

SEQ ID NO: 4764 - RNA, 1644 nt, Artificial Sequence
  capsid_protein_VP1__Norovirus__BAN16289
augaagauggcgucgaaugacgcugcuccaucgaaugauggugcugccaaccucguaccagaggccaacaaugagguuauggcacuugaaccgguggugggagccucaaucgcagcuccugucgucggucaacaaaauauaauugaccccuggauuagagaaaauuuuguccaagcaccacagggcgaguucaccgucucaccgaggaacucgccuggugagaugcuguuaaaucuugaauugggcccagaacucaaccccuaccuaagucaccugucccguauguauaauggguaugcugguggcaugcagguucaggugguccuagcugggaacgcguucacagcuggaaaaaucaucuuugccgccguaccaccgcauuuucccguagaaaacaucagugcagcucaaauaacuaugugcccccauguaauuguugaugugagacaacuugaaccaguacuucugccccuuccugacauaaggaacagguucuuucauuacaaucaggagaacaccccccggaugagacuuguggcuaugcuuuauacccccuugagggccaacucuggugaagauguguuuacuguuucuuguagggucuugacccgcccugccccugauuuugaauuuacuuucuugguaccaccaaccguugaaucaaagacuaaaccuuucacacugcccauauuaacucuuggugagcuaucuaacuccagauucccagccccaauagacauguuguauacugacccgaaugagggaauugugguccaaccacaaaaugguagguguacucuugauggcacucugcaagguaccacacaacugguccccacccaaauuugugcuuucaggggcacauuaauuggacaaacgucaagaucuucagacucaaccgacucagccccucggagaagggaccacccacuccaugugcaauugaagaaccuugauggcacgcaguacgacccaacugaugaagugccagcgguccuuggugccauugacuucaaggggacuguccuugggguggccagucagagagaugugucagggcaacaagugggagcaacucgagcucaugaagugcacaucaacacaacugauccuagguauacaccaaaacugggauccauucucaugcacucagagucggacgacuuugugacuggacagccgguccgcuucacacccauaggaaugggugacaacgacuggcaccagugggagcugccugacuacucuggacaccuaacccuaaacaugaaccuugccccagcagucgcuccugcuuuuccgggcgagaggauucucuucuucaggucaauagucccgucugcugguggcuaugggucuggacaaauagauugccucauaccacaggaguggguucagcauuucuaccaggaagcugcaccaucccaaucugccguggcacucauuagguaugucaauccugacacaggcagaaacaucuuugaggccaaauugcacagggaagguuucauuaccguggcaaauucugguaacaaucccauuguuguucccccuaauggguauuuuagguuugaggcuugggugaaucaauuuuacacuuugacccccaugggaacuggucaggggcguaggaggaaucaauaa

SEQ ID NO: 4765 - RNA, 1644 nt, Artificial Sequence
  capsid_protein_VP1__Norovirus__BAN16291
augaagauggcgucgaaugacgcugcuccaucgaaugauggugcugccaaccucguaccagaggccaacaaugagguuauggcacuugaaccgguggugggagccucaauugcagcuccugucgucggucaacaaaauauaauugaccccuggauuagagaaaauuuuguucaggcaccacagggugaguuuacuguuucaccaagaaacucgccuggugagaugcuuuuaaaucuugaauuaggcccagagcucaacccuuaccugagccauuuaucccgcauguacaaugguuaugcugguggcaugcagguucaggugguccuagcugggaaugcguucacagcuggaaaaaucaucuuugccgccguuccaccacauuucccuguagagaauauuagugcagcucaaauuacaaugugcccccaugugauuguugaugugagacagcuugaaccuguacuuuugccccucccugacauaaggaauagauucuuucacuauaaccaggaagacaccccccggaugagacuuguagccauguuguacacaccucuuagagcaaacucuggugaggacguguucacagugucuugcagagucuugacccgcccagccccugacuuugaguucacguucuuagugccaccaaccguagaaucaaagaccaagccuuucacacucccuauuuugacccuaggggaacuauccaacuccagauucccugcuccaauagauaugcuguacacagaucccaacgagacaauugugguacaaccacaaaauggcagaugcacccuagaugggacacuccaagggaccacccagcuggugcccacccaaauuugcucuuuuaggggcacguugaucagccaaacgucgaggucagcagauucaacagacucagccccacgggugaggaaccauccccuucacguucagaugaagaaccucgacgggacaccauaugacccaacagaugaggugccagcaguucugggugccauagacuucaaaggaacuguguuugggguugcuagccagagaaacaccacagggaacucuguaggggcgacccgugcccaugagguacacauagacaccacaaacccuagauacaccccaaaacuugguucuguguugaugaauucugagucuagugauuuugaugauggacaaccaauucgcuucacucccauuggcaugggagcagaugauuggcaccaaugggaauugcccgaauauucuggucaccuuacucuuaacaugaaccuagcccccgcaguugcuccugcuuuccccggugagcgcauccucuucuucaggucagugguuccaucugcuggugguuacggaucaggccaaauagacugucucaucccacaggaguggguucagcacuucuaccaggaggccgcaccaucacaaucugcgguggcucuuauuagauauguuaacccugacacugggaggaacaucuuugaggcaaagcuacauagagaaggguucauuacuguggcaaauucuggaaacaaccccauaguugugcccccaaauggcuauuucagguuugaggccugggucaaucaauuuuacacacucacccccaugggaacuggacaggggcgcaggagaguccaauaa

SEQ ID NO: 4766 - RNA, 1644 nt, Artificial Sequence
  capsid_protein_VP1__Norovirus__BAN16293
augaagauggcgucgaaugacgcugcuccaucgaaugauggugcugccaaccucguaccagaggccaacaaugagguuauggcacuugaaccgguggugggagccucaauugcagcuccugucgucggucaacaaaauauaauugaccccuggauuagagaaaauuuuguucaggcaccacagggugaguucacuguuucaccaagaaacucgccuggugagaugcuuuuaaaucuugaauuaggcccagagcucaacccuuaccugagccauuuaucccgcauguacaaugguuaugcugguggcaugcagguucaggugguccuagcugggaaugcguucacagcuggaaaaaucaucuuugccgccguuccaccacauuucccuguagagaauauuagugcagcucaaauuacaaugugcccccaugugauuguugaugugagacagcuugaaccuguacuuuugccccucccugacauaaggaauagauucuuucacuauaaccaggaagacaccccccggaugagacuuguagccauguuguacacaccucuuagagcaaacucuggugaggacguguucacagugucuugcagagucuugacccgcccagccccugacuuugaguucacguucuuagugccaccaaccguagaaucaaagaccaagccuuucacacucccuauuuugacccuaggggaacuauccaacuccagauucccugcuccaauagauaugcuguacacagaucccaacgagacaauugugguacaaccacaaaauggcagaugcacccuagaugggacacuccaagggaccacccagcuggugcccacccaaauuugcucuuuuaggggcacguugaucagccaaacgucgaggucagcagauucaacagacucagccccacgggugaggaaccauccccuucacguucagcugaagaaccucgacgggacaccauaugacccaacagaugaggugccagcaguucugggugccauagacuucaaaggaacuguguuugggguugcuagccagagaaacaccacagggaacucuguaggggcgacccgugcccaugagguacacauagacaccacaaacccuagauacaccccaaaacuugguucuguguugaugaauucugagucuagugauuuugaugauggacaaccaauucgcuucacucccauuggcaugggagcagaugauuggcaccaaugggaauugcccgaauauucuggucaccuuacucuuaacaugaaccuagcccccgcaguugcuccugcuuuccccggugagcgcauccucuucuucaggucagugguuccaucugcuggugguuacggaucaggccaaauagacugucucaucccacaggaguggguucagcacuucuaccaggaggccgcaccaucacaaucugcgguggcucuuauuagauauguuaacccugacacugggagaaacaucuuugaggcaaagcuacauagagaaggguucauuacuguggcaaauucuggaaacaaccccauaguugugcccccaaauggcuauuucagguuugaggccugggucaaucaauuuuacacacucacccccaugggaacuggacaggggcgcaggagaguccaauaa

SEQ ID NO: 4767 - RNA, 1644 nt, Artificial Sequence
  capsid_protein_VP1__Norovirus__BAN16295
augaagauggcgucgaaugacgccgcuccaucgaaugauggugcugccaaccucguaccagaggccaacaaugagguuauggcacuugaaccgguggugggagccucaauugcagcuccugucgucggucaacaaaauauaauugaccccuggauuagagaaaauuuuguucaggcaccacagggugaguuuacuguuucaccaagaaacucgccuggugagaugcuuuuaaaucuugaauuaggcccagagcucaauccuuaccugagucauuuaucccgcauguauaaugguuaugcagguggcaugcagguucaggagguccuagcugggaaugcguucacagcugguaaaaucaucuuugccgccguuccaccacauuucccuguagagaacauuagugcagcucaaaucacaaugugcccccaugugauuguugauguaaggcagcuugagccuguacucuugccccucccugacauaaggaauagauucuuucacuacaaccaggaagacaccccccggaugagacuuguggccauguuguacacaccccuuagagcaaacucuggugaggacguguucacaguuucuugcagggucuugacccgcccagccccugacuuugaguucacguucuuagugccaccaaccguagaaucaaagaccaagccuuuuacacucccuauuuugacccuaggggaacuauccaauuccagauucccugcuccaauagauaugcuguacacagaucccaaugagacaaucgugguacaaccacaaaauggcaggugcacccuagaugggacacuccaagggaccacccagcuggugcccacccaaauuugcucuuuuaggggcacguugaucagccaaacgucgaggucugcagauucaacagauucagcuccacgggugaggaaccauccccuucacguucagcugaagaaccucgacgggacaccauaugacccaacagaugagguaccggcaguucugggugccauagauuucaaaggaacuguguuuggagucgcuagccagagaaacaccacagggagcucuguaggggcgacccgugcccacgaggugcacauagacaccacaaacccuagauacaccccaaaacuugguucuguguugaugcauucugagucuagugauuuugaugauggacaaccgacucgcuucacccccauuggcaugggagcagaugauuggcgccaaugggaauugcccgaauauucuggucaccuuacucucaacaugaaccuagcccccgcaguugccccugcuuuccccggugagcgcauccucuucuucaggucagugguuccaucugcuggugguuacggaucgggacaaauagacugccucaucccacaggaauggguucagcacuucuaucaggaggccgccccaucacaaucugcgguggcucuuauuagauauguuaacccugacacugggagaaacaucuuugaggcaaagcuacauagagaaggguucaucacuguggcaaauucuggaaacaaccccauaguugugcccccaaaugguuauuucagguuugaggccugggucaaucaauuuuauacacucacccccaugggaacuggacaggggcgcaggagaguccaauaa

SEQ ID NO: 4768 - RNA, 1653 nt, Artificial Sequence
  capsid_protein_VP1__Norovirus__BAN16297
augaagauggcgucgaaugacgccgcuccaucgaaugauggugcugccaaccucguaccagaggccaacaaugagguuauggcacuugaaccggugguaggagccucaaucgcagcuccuguugucggucagcaaaauauaauugaccccuggauuagagaaaauuuuguccaagcaccacagggcgaguucacuguuucgccaaggaauucgcccggugagaugcuuuuaaaccuugaauugggcccagaacuuaaccccuauuugagucauuugucccgcauguacaacggauaugcugguggcaugcagguucaggugguccuagcugggaaugcguucacagcugggaaaaucaucuuugccgccguaccaccacauuuuccuguggauaauauuagugcagcucagauaacuauguguccccaugugauuguugaugugagacagcuugaaccagugcuucugccccuccccgauauaaggaacagguucuuccauuacaaucaggaaaacaccccccggaugagacucguggccaugcucuacacgccccugagggcuaauucuggugaggacguguucacugugucuuguaggguucugacccgccccgcuccagauuuugaguucacauucuuaguaccaccaacuguugaaucaaaaacaaaaccuuuuacucuaccuguucuaacucuuggugaauugucuaacucccguuuuccggcugcuauagauaugcuuuauacugaucccaaugaaucaauaguuguccaaccccaaaaugguaggugcacucuugauggcacauugcaaggcacaacacaauugguuccaacacaaauuugugcuuuuagaggcacccugaucagccaaaccgcgagagcggccgacucaguagauuccccccagagagcccgugaucauccauuacacguccaggucaagaaccuagacgguacacaguaugacccaacagaugauauaccugcaguucugggggcuauugauuucaaaggcacaguauuuggaguggcuagucagagggaugucucuggaacacaagaacagggccauuaugccacccgggcccaugaagcacacauugacacaacugacccaaaguaugcacccaaauuaggcacaauucuuaucaaaucugauuccaaugauuuuaauacaaaucaacccauuagguucaccccagugggcaugggugacaacaauuggagacagugggaauuaccugauuacucugguagauuaaccuuaaacaugaaccuugcccccgcugucuccccaucuuucccuggugaacgaauccuuuucuuuaggucuauagugccaucagcuggaggcuacgggucuggcuauauagacugucucauaccccaggaaugggugcaacacuucuaccaggaagcagcgccuucacaauccgccguugcacugguuagguauguuaaccccgacacugggcguaacaucuuugaggccaaguugcacagagaaggguuccucaccguggccaauucuggaaacaaccccauuguaguccccccuaaugguuauuuuagauuugaggcuuggguuaaucaguuuuauacacuugcccccaugggaucuggacaggggcguagaagggcccaguaa

SEQ ID NO: 4769 - RNA, 1623 nt, Artificial Sequence
  capsid_protein_VP1__Norovirus__BAR42289
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaauauaauugaccccuggauuagaacaaauuuugugcaagcaccaaauggagaguucacagugucacccagaaacucuccuggagaaauuuuauuaaauuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccggcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguuuccaguccccaucgauucgcuuuucaccgcccagaauaauguguugcaggugcagugucaaaauggcagguguacacuugauggugaguuacaaggcacaacccaguugcucccaacuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 4770 - RNA, 1617 nt, Artificial Sequence
  capsid_protein_VP1__Norovirus__BAR47616
augaagauggcgucgaaugacgccgcuccaucuaaugauggugcugcuggucucguaccagagggcaacaacgagacccuuccccuagaaccaguugcgggcgcagcuauagccgcacccgucacuggccaaaacaacauaauugaccccuggauuagaacaaauuuugugcaagcaccaaauggagaguucacagugucacccagaaacucuccuggagaaauuuuacuaaaccuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagauuacaaugcucccacauuuaauaguagaugucaggacucuugaaccaauuaugaucccacucccugauguuaggaauacauucuuccauuauaacaaccagccuaacagccgcaugagauuaguggcuaugcucuacaccccccuuagaucuaauggcucaggugaugaugucuuuacugucucuugcaggguuuugacuaggccuacuccugauuuugaguucacuuauuuagugccaccuucuguugaaucuaagacuaagccuuuuuccuuaccuauuuuaacccuuucugagcucacaaauucgagguucccaguccccaucgauucgcuuuucaccgcccagaauaauguguugcaggugcagugucaaaauggcaggugcacacuugauggugaguuacaaggcacaacccaguugcucccaucuggcaucugugcauucagaggacgggugacagcagaaacugaccaucgugacaaguggcacaugcaacugcaaaaccucaauggcacaacauaugacccaacugaugaugugccagccccgcuggguacaccugacuucaagggcgucguguuugggguagcaagccaaagaaauguggguaaugaugcgccuggcucaaccagggcccaugaggcggugauuucaaccuauagcccccaauuuguucccaaauuagguucugucaauuuuagaaguaaugauaaugauuuccaauugcagccgacaaaauucacaccagugggcaucaaugacgauggugaccacccguucagacagugggaacuaccagacuauucagggcugcuuaccuugaauaugaaccuugcccccccgguugcuccaaauuucccuggugaacaauuauuauucuucagaucuuuugugccaugcucaggagguuauaaccaaggcauuguagauugucuuauuccccaagaauggauccaacacuucuaucaggaaucagcgcccucccagucagacguggcccuaaucagguauguuaaccccgauacgggacguacacuguuugaagcaaaauugcacagaucugguuacauuacuguggcucacucuggagacuauccucuuguuguuccggcuaauggauacuuuagauuugauucuuggguaaaucaguuuuacucacucgccccaaugggaacuggaaaugggcgaaggagggcucaguaa

SEQ ID NO: 4771 - RNA, 1617 nt, Artificial Sequence
  capsid_protein_VP1__Norovirus__BAR63715
augaagauggcgucgaaugacgccgcuccaucuaaugauggugcugcuggucucguaccagagggcaacaacgagacccuuccccuagaaccaguugcgggcgcagcuauagccgcacccgucacuggccaaaacaacauaauugaccccuggauuagaacaaauuuugugcaagcaccaaauggagaguucacagugucacccagaaacuccccuggagaaauuuuacuaaaccuagaguugggcccugauuugaacccuuauuuggcucauuuaucaaggauguacaauggguaugcugguggaguggaaguucagguucuccuggcagggaacgcguucacugccggaaagauccucuucgccgccgucccgccaaauuucccaguggaauucuuaagcccagcccagauuacaaugcucccacauuuaauaguagauguaaggacucuugaaccaauuaugaucccacucccugauguuaggaauacauucuuccauuauaacaaccagccuaacagccgcaugagauuaguggcuaugcucuacaccccccuuagaucuaauggcucaggugaugaugucuuuacugucucuugcaggguuuugacuaggccuacuccugauuuugaguucacuuauuuagugccaccuucuguugaaucuaagacuaagccuuuuuccuuaccuauuuuaacccuuucugagcucacaaauucgagguucccaguccccaucgauucgcuuuucaccgcccagaauaauguguugcaggugcagugucaaaauggcaggugcacacuugauggugaguuacaaggcacaacccaguugcucccaucuggcaucugugcauucagaggacgggugacagcagaaacugaccaucgugacaaguggcacaugcaacugcaaaaccucaauggcacaacauaugacccaacugaugaugugccagccccgcuggguacaccugacuucaagggcgucguguuugggguagcaagccaaagaaauguggguaaugaugcgccuggcucaaccagggcccaugaggcggugauuucaaccuauagcccccaauuuguccccaaauuagguucugucaauuuuagaaguaaugauaaugauuuccaauugcagccgacaaaauucacaccagugggcaucaaugacgauggugaccacccguucagacaaugggaacuaccagacuauucagggcugcuuaccuugaauaugaaccuugcccccccgguugcuccaaauuucccuggugaacaauuauuauucuucagaucuuuugugccaugcucaggagguuauaaccaaggcauuguagauugucuuauaccccaagaauggauccaacacuucuaucaggaaucagcgcccucccagucagacguggcccuaaucagguauguuaaccccgacacgggacguacacuguuugaagcaaaauugcacagaucugguuacauuacuguggcucacucuggagacuauccucuuguuguuccggcuaauggauacuuuagauuugauucuuggguaaaucaguuuuacucacucgccccaaugggaacugggaaugggcgaaggagggcucaguaa

SEQ ID NO: 4772 - RNA, 1617 nt, Artificial Sequence
  capsid_protein_VP1__Norovirus__BAR63718
augaagauggcgucgaaugacgccgcuccaucuaaugauggugcugcuggucucguaccagagggcaacaacgagacccuuccccuagaaccaguugcgggcgcagcuauagccgcacccgucacuggccaaaacaacauaauugaccccuggauuagaacaaauuuugugcaagcaccaaauggagaguucacagugucacccagaaacuccccuggagaaauuuuacuaaaccuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagauuacaaugcucccacauuuaauaguagaugucaggacucuugaaccaauuaugaucccacucccugauguuaggaauacauucuuccauuauaacaaccagccuaacagccgcaugagauuaguggcuaugcucuacaccccccuuagaucuaauggcucaggugaugaugucuuuacugucucuugcaggguuuugacuaggccuacuccugauuuugaguucacuuauuuagugccaccuucuguugaaucuaagacuaagccuuuuuccuuaccuauuuuaacccuuucugagcucacaaauucgagguucccaguccccaucgauucgcuuuucaccgcccagaauaauguguugcaggugcagugucaaaauggcaggugcacacuugauggugaguuacaaggcacaacccaguugcucccaucuggcaucugugcauucagaggacgggugacagcagaaacugaccaucgugacaaguggcacaugcaacugcaaaaccucaacggcacaacauaugacccaacugaugaugugccagccccgcuggguacaccugacuucaagggcgucguguuugggguagcaagccaaagaaauguggguaaugaugcgccuggcucaaccagggcccaugaggcggugauuucaaccuauagcccccaauuuguccccaaauuagguucugucaauuuuagaaguaaugauaaugauuuccaauugcagccgacaaaauucacaccagugggcaucaaugacgauggugaccacccguucagacagugggaacuaccagacuauucagggcugcuuaccuugaauaugaaccuugcccccccgguugcuccaaauuucccuggugaacaauuauuauucuucagaucuuuugugccaugcucaggagguuauaaccaaggcauuguagauugucuuauuccccaagaauggauccaacacuucuaucaggaaucagcgcccucccagucagacguggcccuaaucagguauguuaaccccgauacgggacguacacuguuugaagcaaaauugcacagaucugguuacauuacuguggcucacucuggagacuauccucuuguuguuccggcuaauggauacuuuagauuugauucuuggguaaaucaguuuuacucacucgccccaaugggaacugggaaugggcgaaggagggcucaguaa

SEQ ID NO: 4773 - RNA, 1617 nt, Artificial Sequence
  capsid_protein_VP1__Norovirus__BAR63721
augaagauggcgucgaaugacgccgcuccaucuaaugauggugcugcuggucucguaccagagggcaacaacgagacccuuccccuagaaccaguugcgggcgcagcuauagccgcacccgucacuggccaaaacaacauaauugaccccuggauuagaacaaauuuugugcaagcaccaaauggagaguucacagugucacccagaaacuccccuggagaaauuuuacuaaaccuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagauuacaaugcucccacauuuaauaguagaugucaggacucuugaaccaauuaugaucccacucccugauguuaggaauacauucuuccauuauaacaaccagccuaacagccgcaugagauuaguggcuaugcucuacaccccccuuagaucuaauggcucaggugaugaugucuuuacugucucuugcaggguuuugacuaggccuacuccugauuuugaguucacuuauuuagugccaccuucuguugaaucuaagacuaagccuuuuuccuuaccuauuuuaacccuuucugagcucacaaauucgagguucccaguccccaucgauucgcuuuucaccgcccagaauaauguguugcaggugcagugucaaaauggcaggugcacacuugauggugaguuacaaggcacaacccaguugcucccaucuggcaucugugcauucagaggacgggugacagcagaaacugaccaucgugacaaguggcacaugcaacugcaaaaccucaauggcacaacauaugacccaacugaugaugugccagccccgcuggguacaccugacuucaagggcgucguguuugggguagcaagccaaagaaauguggguaaugaugcgccuggcucaaccagggcccaugaggcggugauuucaaccuauagcccccaauuuguucccaaauuagguucugucaauuuuagaaguaaugauaaugauuuccaauugcagccgacaaaauucacaccagugggcaucaaugacgauggugaccacccguucagacagugggaacuaccagacuauucagggcugcuuaccuugaauaugaaccuugcccccccgguugcuccaaauuucccuggugaacaauuauuauucuucagaucuuuugugccaugcucaggagguuauaaccaaggcauuguagauugucuuauuccccaagaauggauccaacacuucuaucaggaaucagcgcccucccagucagacguggcccuaaucagguauguuaaccccgauacgggacguacacuguuugaagcaaaauugcacagaucugguuacauuacuguggcucacucuggagacuauccucuuguuguuccggcuaauggauacuuuagauuugauucuuggguaaaucaguuuuacucacucgccccaaugggaacuggaaaugggcgaaggagggcucaguaa

SEQ ID NO: 4774 - RNA, 1623 nt, Artificial Sequence
  capsid_protein_VP1__Norovirus__BAS02083
augaagauggcgucgagugacgccaacccaucugauggguccgcagccaaccucgucccagaggucaacaaugagguuauggcucuggagcccguugucggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucucauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugacuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaccacagguagucauaacuacacaaugaauuuggcuucucaaaauuggagcaauuacgacccaacagaagaaaucccagccccucuaggaacuccagacuuuguggggaagauucaaggcgugcuuacccaaaccacaaggacagauggcucaacacgcggccacaaagccacaguuuauacugggagcgccgacuuugcuccaaaacuggguagaguucaauuugaaacugacacaaaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagguuugugaauccagacacagguaggguuuuguuugaauguaagcuucauaaaucagguuaugucacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 4775 - RNA, 1635 nt, Artificial Sequence
  capsid_protein_VP1__Norovirus__CRL46952
augaugauggcgucuaaggacgcuacaccaagcgcagauggcgccacuggcgccggccagcugguaccggagguuaauacagcugacccuauacccauugacccuguggcuggcuccucuacagcccuugccacugcgggucaaguuaauuugauugaucccuggauaaucaauaauuuugugcaagccccucagggcgaguucacaauauccccaaauaauacccccggugaugugcuauuugauuugcaguuagggccucaucugaauccuuuucuuucccaucuuucucagauguacaauggcugggugggcaacaugcgaguacguguuguuuuggcugguaaugcuuuuacggcugggaagguuauaauuuguuguguucccccuggcuuucaaucucgcacccuuuccauagcucaggcuacucuauuuccccauguuauugcugauguuaggacucuugauccuguagaagugccccuugaagauguuaggaauguguuguaucauaauaaugauacccaaccuaccaugcgccuccuuugcauguuguacaccccucuucgaacugggggggcgucuggugggacugauucuuuugugguggcugggcgugugcuuacuugcccaggcccugacuuuaacuucuuauuccuaguuccuccuacagucgagcaaaagacucgcccuuuuacugugccuaauauuccuuugaaguaucugucuaauucuaggaucccaaacccuauugaggguaugucuuugucaccugaccagacccaaaauguucaauuccagaaugguagguguacaauugacggucagccccucgggaccacaccugucucaguuagccaguuauguaaguuuagggguaggauuacaucuggacagagggugcucaaucugacagaguuagacgguucaccuuuuauggccuuugccgcccccgcccccgcgggcuuuccagaucucgggucuugugauuggcauauugaaaugaguaaaauuccaaacuccagcacccagaauaauccaauaguaguuaauucugucaaacccaauagucaacaguuugucccgcauuugucaaguaucacccuugaugauauuguuucuagugggggugacuauauuggcacuauacaauggaccucuccuccuucugauuccggcggagccaacacaaauuuuuggaagauuccugacuaugggucuagccuaucagaagccucacagcuggcccccgcugucuauccaccuggcuucaaugaggugauuguguacuuuauggcaucuauaccuggucccaaucaaucugguucccccaauuuggugccaugccuucucccccaggaauauauaacacauuuuaucagugagcaggcccccauucagggugaggcugccuuacuccauuauguagacccagacaccaaucguaauuugggugaguucaaguuguauccuggugguuaucugacuuguguuccuaauaguucuaguacuggaccucaacagcuuccucuugaugguguguuugucuuugcuucuuggguuucuagauuuuaucaauuaaagccugugggaacagccggaccggcuagagguaggcuugguguccgcagauaa

SEQ ID NO: 4776 - RNA, 1623 nt, Artificial Sequence
  capsid_protein_VP1__Norovirus__CRL46955
augaugauggcgucuaaggacgccccaacauccccugauggcgccaguggcgccggccagcugguaccggaggcuaauacagcugagcaaauuucaauggacccuguugcgggugcuucaacagcagucgcgacggcugggcaagugaauaugauugacccauggauuuuuaauaacuuuguccaggcaccucaaggagaauucacuauuuccccuaauaauacccccggugauauuuuguuugauuuacaauugggaccccaccuuaauccauuuuuagcccaucucucacagauguauaaugguugggucggcaauaugcgugugcgcauacuguuggccgggaaugccuuuacagcuggaaagauaaucauuugcuguguccccccuggcuuugaugcuagaauacuuacaauagcucaagcaacccucuucccacacuuaauugcugauguuaggacccuugagccuguggagcuuccuuuggaggaugugcgcaacguucucuaccacaauaguagucagccgcagccaacaaugcggcugguugcuauguuguacacuccccuccgcacugguggugguuccggaggcacugaugccuuugugguggcggguagggugcuuacgugccccgcccccgauuuuaguuuccuguuucuuguuccucccuccguugaacaaaagacuagaguuuucaguguccccaauauaccccugaaagaucucucaaauucucguguccccguacccauacagggcauguuuauguccccagauguuaaucagucaguccaguuucagaaugggcgcugccagauugauggucaacuccagggcaccaccccagucucgcucagccaacucugcaagauuagggguaaaacuucuaguaaugccagggugcucaacuuaagcgagguagauggcacaccuuuuaucccccuugaaucaccagcgccaguugguuuucccgacuuaggagguugugacuggcaugugaauuucacuuuccaggcucaaaaccaggacccaucccaaagugugaccuuugcaacuaaugaugccagcuuugucccuuaccuagguagcauuuccccucauaaugggggagacuuucaugcaggcgacaucauagguagccuuggauggauuucagccccgucugacaauucacaacuuaauguuuggacaauaccaaaguacggaucuagucucccagaugucacucaucuugcuccugcuguguuccccccaggcuuuggggaagugauccuauacuucuauucuaccuucccagguucuggacaaccuagucaacuucaagucccauguuuguugccccaggaguucaucacccacuucuguaaugaacaagcucccaucgcuggggaggcugcucuccuccacuacguggacccugauacgggccggaacuugggggaguucaaacuuuacccugauggauuuaugaccugugucccuaauaguguuagcaguggcccucaaacccuaccuaucaauggagucuuugucuuuguuucauggguguccagauucuaucaacucaagccugugggaacggccucagcggcuagaaggcuuggacugcggcgcauauaa

SEQ ID NO: 4777 - RNA, 1623 nt, Artificial Sequence
  capsid_protein_VP1__Norovirus__CRL46958
augaagauggcgucgaaugacgccaacccaucugauggguccgcagccaaccucgucccagaggucaacaaugagguuauggcuuuggagcccguugucggugccgcuauugcggcgccuguagcgggccaacaaaauauaauugaccccuggauuagaaacaauuuuguacaagccccugguggagaguucacaguauccccuagaaacgcuccaggcgaaauacuauggagcgcgcccuuaggaccugauuugaaucccuaccuaucucauuuggccagaauguauaaugguuaugcaggugguuuugaagugcaggugauccuugcggggaacgcguucaccgcuggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaccauuauaaucagucaaaugacucuacuauuaaauugauagcaauguuguauacaccacuuagggcuaacaaugcuggggaugauguuuucacagucucuugucgaguacucacgaggccauccccugauuuugauuuuauauuuuugguaccacccacaguugagucaagaacuaaaccauuuacuaucccaaucuuaacuguugaagaaaugaccaauucaagauuccccauuccuuuggaaaaguuguacacgggucccagcagugccuucguuguccaaccacaaaacggcagaugcacgacugauggcgugcucuuaggcaccacucaacugucuccugucaacaucugcaccuucagaggggaugucaccaacauucaagguucccacacuuacacaaugaauuuggcuucucuaaauuggaacaauuaugacccaacagaagaaacuccagccccucuaggaacuccagauuucgugggaaagauccaaggugugcucacucaaaccacaaagggacaaggcucgacccguggccauaaagccacaguauacacugggagugccuccuuuacuccaaagcuaggcaguguucaauuuagaacugauacacaaaaugauuuuguaacucaccaaaacacaaaauucaccccagucgguguuauccaggauggugacaccacccaccgaaaugaaccccaacaaugggugcucccaaauuauucagguguaaauacccauaaugugcaccuagccccugcuguagcucccaccaucccgggugaacaacuucucuucuucagguccaguaugcccggaugcagcggguaucccaacauggauuuggauugccuagucccccaggaaugggugcagcacuucuaccaggaggcagcuccagcacuaucugauguggcucuauugagauuugugaauccagacacugguaggguccuguuugaguguaaacuucauaaaucaggcuauguuacaguggcccacaccggccaucaugauuuggucaucccucccaauggcuauuuuagguuugauuccuggguuaaccaauuuuacacacuugcccccaugggaaauggaacggggcguagacguguuuuauaa

SEQ ID NO: 4778 - RNA, 1623 nt, Artificial Sequence
  capsid_protein_VP1__Norovirus__CRL46961
augaagauggcgucgagugacgccaacccaucugauggguccgcagccaaccucguaccagaggucaacaaugagguuauggcucuggagcccguuguuggugccgcuauugcggcaccuguagcgggccaacaaaauguaauugaccccuggauuagaaacaauuuuguacaagccccugguggagaguuuacaguguccccuagaaacgcuccaggugaaauacuauggagcgcgcccuuaggcccugaucuaaaucccuaccuaucccacuuagcuagaauguacaaugguuaugcaggugguuuugaagugcagguaauucucgcggggaacgcguucaccgcugggaagaucauauuugcagcagucccaccaaauuuuccaacugaaggcuuaagccccagccagguuacuauguucccccauauaauaguagauguuagacaacuagaaccugugcugauucccuuacccgaugucaggaauaauuucuaucauuacaaucaaucaaaugacuccacuauuaaguugauagcaauguuguauacaccacuuagggcuaauaaugcuggggacgaugucuucacaguuucuugccgaguucucacgagaccaucccccgauuuugauuuuauauuuuuagugccacccacaguugagucaagaacuaagccauucucugucccaguuuuaacuguugaggagaugaccaauucaagauuccccaucccuuuggaaaaguuguucacgggucccagcagugccuuuguuguucaaccacaaaacggcaggugcacgacugauggcgugcuccuaggcaccacccaacuguccccugucaacaucugcaccuucagaggggauguuagccacaucacagguagucguaacuacacaaugaauuuggcuucucaaaauuggaacaauuaugacccaacagaagaaaucccagccccucuaggaacuccagauuuuguggggaagauucaaggcaugcucacucaaaccacaagggcagaugguucaacacgcggccacaaagcuacaguguacacugggagcgccgacuuugcuccaaaacuggguagaguucaauuugaaacugacacagaccaugauuuugaagcuaaccaaaacacaaaguucaccccggucggugucauccaagaugguagcaccacccaccgaaaugaaccccaacagugggugcucccaaguuacucaggcagaaauacucacaaugugcaucuggcccccgcuguagcccccacuuuuccgggugaacaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucagguuauguuacaguggcucacacuggucaacaugauuugguuauuccccccaacgguuacuuuagguuugauuccugggucaaccaguucuacacgcuugcccccaugggaaauggaacggggcguagacgugcaguauaa

SEQ ID NO: 4779 - RNA, 1623 nt, Artificial Sequence
  capsid_protein_VP1__Norovirus__CRL46964
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugauuuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauagugguagauguuaggcaacuagaaccuguguugauucccuuacccgauguuaggaauaauuuuuaucauuauaaucaaucaaaugaccccaccauuaaauugauagcaauguuguacacaccacuuagggcuaauaaugcuggggaugaugucuucacaguuucuugccgaguucucacgaggccaucccccgauuuugauuucauauuucuagugccacccacaguugagucaagaaccaaaccauucucugucccaguuuuaacuguugaggaaaugaccaauucaagauuccccauuccuuuggaaaaguuguucacaggucccagcagugacuuuguuguccaaccacaaaacggcaggugcacgacugauggcgugcuccuaggcaccacccaacugucuccugucaauaucuguaccuucagaggagaugucacccauaccacagguagucguaacuacacaaugaauuuggcuucucaaaauuggaacaauuaugacccaacagaagaaaccccagccccucuaggaacuccagacuuuguggggaagauucgaggcaugcucacccaaaccacaagggcagauggcucaacacgcggccacaaagccacaguguacacugggagcgccgacuuugcuccaaaacuggguagaguucaauuugaaacugacacagacaaugauuuugaugcuaaccaaaacacaaaguucaccccagucggugucauccaagaugguaccaccacccaccgaaaugaaccccgacagugggugcucccaaguuacucaggcagaaacacucauaauguacaucuagccccugcuguagcccccacuuuuccgggugagcaacuucucuucuucagauccaccaugcccggaugcagcggguaccccaacauggauuuggacuguuugcucccccaggaaugggugcaguucuucuaccaagaggcagccccagcacaaucugauguggcucugcuaagauuugugaauccagacacagguaggguuuuguuugaguguaagcuucauaaaucaggcuauguuacaguggcucacacuggcccacaugauuugguuauuccccccaaugguuauuucagauuugauuccugggucaaccaguucuacacgcucgcccccaugggaaauggaacggggcguagacgugcaguauaa

SEQ ID NO: 4780 - RNA, 1644 nt, Artificial Sequence
  capsid_protein_VP1__Norovirus__CRL46967
augaagauggcgucgaaugacgcugcuccaucgaaugauggugcugccaaccucguaccagaggccaccagugagguuauggcacuugagccgguggugggagccucaauugcugcuccugucgucggccaacaaaauauaauugaccccuggauuagagaaaauuuuguucaggcaccacagggugaguuuacuguuucaccaaggaacucaccuggugagaugcuucuaaaucuugaauuaggcccugagcucaauccuuaucugagucacuugucccgcauguauaacggcuaugcuggugguaugcagguucaggugguccuagcugggaaugcguucacagcugguaaaaucaucuuugccgccgucccaccacauuuuccuguugagaacauuagugcagcccaaauuacaaugugcccccauguaauuguugaugugagacagcuugagccagugcuuuugccccucccugacauaaggaauagauucuuucauuauaaucaggaaaauaccccccggaugagacuuguggcuauguuguauacaccccuuagagcaaauucuggugaggauguguuuacggugucuugcagaguucugacccgcccugcccccgacuuugaguucacguucuuggugccaccaacuguggagucaaagacuaagcccuuuacacucccuauuuuaacucuuggugagcuauccaacuccagauuccccgcuccgauagacauguuguacacugacccuaaugaggcaauuguggugcaaccacaaaauggcaggugcacucuagauggaacacuucaagggaccacccaacugguacccacccaaauuugcuccuucaggggcacgcuaauuagccagacgucgaggucugcagauucaacagauucagccccacgggugaggaaccacccucuccacguucagcugaagaaccucgaugggacaccauaugacccaacagaugaggugccagcaguuuugggugccauagacuucaaaggaacuguguuuggggucgcuagucaaagaaacaccacagggagcucuauaggagcaacccgcgcccaugaagugcauauagauaccacaaacccuagauaugccccaaagcuuggcucuguguugauguauucugaaucuacugauuuugaugauggacaacccacccgcuucacccccauuggcaugggagccgaugauuggcaccaaugggaauuacccgaguauucuggucaccuuacucuuaacaugaauuuggcccccgcaguugccccugcuuucccuggugagcgcauccucuucuucagaucaguggugccaucugcugguggcuauggaucaggucacauagauugccucaucccacaggaguggguucagcauuuuuaccaggaggccgcuccaucacagucugcgguggcucucaucagauaugucaacccugacacuggaagaaacaucuuugaggcaaaacugcauagagaaggguucaucacuguggcaaauucuggaaacaaccccauaguugugcccccaaaugguuacuucagguuugaggccugggucaaucaauucuacacacucacccccaugggaacuggacaggggcgcaggagaguucaauaa

SEQ ID NO: 4781 - RNA, 1647 nt, Artificial Sequence
  capsid_protein_VP1__Norovirus__CRL46970
augaagauggcgucgaaugacgccgcuccaucuaaugauggugccgccggccucgucccagagaucaacaaugaggcaauggcgcuagagccaguggcgggugcagcgauagcagcaccccucacuggucagcaaaauauaauugaucccuggauuaugaauaauuuugugcaagcaccugguggugaguuuacagugucccccagaaauuccccuggugaaguucuucuuaauuuggaauugggcccagaaauaaaucccuauuuggcccaucuugcuagaauguauaaugguuaugcagguggauuugaagugcaggugguccuagcuggaaaugcguuuacagcaggaaagauaaucuuugcagcuauuccccccaacuuuccaauugacaauuuaagugcagcacagaucacuaugugcccacaugugauuguagaugucagacaguuggaaccagucaaccucccgaugccugacguucgcaauaacuucuuucauuauaaucaagggucugauucgagguuacgccuaauugcaaugcuauauacaccucuuagagcaaacaauucuggggaugauguuuuuacugugucuuguagagugcuaacuagaccuaguccugacuucucauucaauuuccuugugccaccuacuguggagucaaagacaaaacccuucucccucccuauccugacuauuucugaaaugucuaauucuagguucccaguaccaauugauucucugcacaccaguccuacugagaauauuguuguucagugccaaaaugggcgcgucacccuugauggugaguugaugggcaccacccaacucuugccuagccaaaucugugcuuucaggggaguucucaccagaucaacaagcagggccagugaccaggccgauacagcaaccccuagauuguuuaauuauuauuggcauauacaauuggauaaucuaaauggaaccccuuaugauccugcagaagacauaccaggcccccuagggacaccagauuuccguggcaaagucuuuggcguggccagccagagaaaucuugauaccacgacuagggcacaugaagcaaagauagacaccacaucuggccgcuucaccccaaagcuaggcucauuagaaauauccacugaaucuagugauuuugaucaaagccaaccaacaagauucaccccaguuggcauuggaguugaccaugaggcagacuuucaacaauggacccuacccgacuacgcuggucaguucacacacaacaugaacuuagcaccagcuguugcucccaacuucccuggugagcagcuccuuuucuuccgcucacauuugccaucuucuggugggcgaucuaacgggauucuagacugccuggucccccaagaauggguacagcacuucuaccaagagucagcccccucucagucucaaguggcccugguuagguauguuaacccugacacugguagaguguuauuugaggccaagcuacacaaauuggguuucaugacuauagccaagaauggugauucuccaauaauuguuccuccaaauggauacuuuagguuugaaucuugggugaaccccuuuuacacacuugcccccaugggaacugggaaugggcguagaaggauucaauaa

SEQ ID NO: 4782 - RNA, 1608 nt, Artificial Sequence
  capsid_protein_VP1__Norovirus__CRL46973
augaagauggcgucgaaugacgccgcuccaucuaaugauggugcagccggucucguaccagaggucaauaacgagacgauggcacuugagccgguggcuggggccuccauagcugccccucuaaccggccaaaacaaugugauagaccccuggauuagaaugaauuuuguucaagccccaaauggugaauuuacaguguccccccguaauuccccaggugaaguguuguuagaauuggaauuaggccccgaauugaauccauuccuggcacaccuuucaagaauguacaaugguuaugcuggugggguugaagugcaggugcuacuugcugggaacgcguucacagcaggaaaacuaguguuugcagcaauccccccacacuucccucuugagaaucugaguccuggucaaauuacaauguucccucauguaauuauugauguuagaacuuuagaaccuguccuuuuaccuuuaccagauguuagaaauaacuucuuucauuacaaucagcagccugaggcccguaugaaacuuguggcuauguuguacacuccucuuagaucuaaugguucuggugaugauguguuuacagucucuuguaggguucucacucgcccuucuccagauuuugauuuuaauuauuugguccccccaacuguggaaucuaaaacuaaaccauucacccugccaauauugaccauuggagaauugucaaauucuagguucccaguaccaauagauauauuguacaccagcccuaaugaaggagugguugugcaaccucaaaauggcagaucaacacucgauggugaacugcuuggcaccacacaaauuguaccaucaaacaucugugccuugcgggggcgcaucaacgcccaugugccaaacgaacccaaucaauggaacuugcagguuacaaaugcaaauggaacucccuuugaccccacugaagaugucccugcgccauugggcacgccggacuuccaggcaaacaucuacggagucacaggucagaggaacucugacagcucuugccgugcccaugaugggguuuuggcaaccuggagcccuaaauuuacaccuaagcuaggaucuguggucuuggguacuugggaaaaagaagauuuuaauaucaaucagccuaccagauucacaccuauugguuugcauaauacagaacacuuuaagcaguggguucuacccaauuauucuggaauguugaccuuaaacaugaauuuggcacccucuguugcuccccucuucccaggugaacaaauacucuucuuuagguccuuuauaccacucaauggaggcaaauccgacggugccauugacugucuacucccucaggaauggauccagcauuucuaucaggaaucagccccaucacccacagacguugcccugauuagguacaccaauccugacacgggccgcguccucuuugaggccaaauuacauagacagggauucauuacaguagcaaguucugguucuaaaccuauuguugucccuccuaaugguuauuuuagguuugauucuuggguuaaucaguuuuauucucucgcccccaugggaacugggaaugggcguagaagggugcaguaa

SEQ ID NO: 4783 - RNA, 1623 nt, Artificial Sequence
  capsid_protein_VP1__Norovirus__CRL46976
augaagauggcgucgaaugacgccgcuccaucugauggguccacagccaaccucgucccagaggucaacaaugagguuauggcuuuggagcccguaguuggugccgcuauugcggcaccuguagcgggccaacaaaauguaauugaccccuggauuagaaacaauuuuguacaagccccugguggagaguuuacaguauccccuagaaacgcuccaggugaaauauuauggagcgcgcccuuaggcccugaucugaaucccuaccuuucucauuuggccagaauguauaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaauuggaaccuguguugauccccuuacccgauguuaggaauaauuucuaccauuauaaucaaucaaaugaccccacuaucaaauugauagcaaugcuguacacaccacuuagggcuaauaaugcuggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaauuguucacgggccccaguagugccuuuguuguucaaccacaaaauggcaggugcacgacugauggcgugcuccuagguacuacccaacuguccccugucaacaucugcaccuucagaggggaugucauccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccucaacaaugggugcucccaaguuacucaggcagaaacauucauaaugugcaccuggcccccgcuguagcccccacuuucccgggcgagcagcuccucuucuuuagaucuacuaugcccggaugcagcggguaccccaacauggauuuggacugucugcucccccaggagugggugcaguacuucuaccaggaggcagccccagcacaaucugauguggcucuguugagauuugugaauccagacacagguaggguuuuguuugaguguaagcuccauaaaucaggcuauguuacaguggcucacacuggucaacaugauuugguuaucccccccaaugguuauuuuagauuugauuccugggucaaccaguucuacacacuugcccccaugggaaaugggacggggcguagacgugcauuauaa

SEQ ID NO: 4784 - RNA, 1623 nt, Artificial Sequence
  capsid_protein_VP1__Norovirus__CRL46979
augaagauggcgucgagugacgccaacccaucugauggguccacagccaaccucgucccagaggucaacaaugagguuauggcuuuggagcccguaguuggugccgcuauugcggcaccuguagcgggccaacaaaauguaauugaccccuggauuagaaacaauuuuguacaagccccugguggagaguuuacaguauccccuagaaacgcuccaggugaaauauuauggagcgcgcccuuaggcccugaucugaaucccuaccuuucucauuuggccagaauguauaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaauuggaaccuguguugauccccuuacccgauguuaggaauaauuucuaccauuauaaucaaucaaaugaccccacuaucaaauugauagcaaugcuguacacaccacuuagggcuaauaaugcuggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaauuguucacgggccccaguagugccuuuguuguucaaccacaaaauggcaggugcacgacugauggcgugcuccuagguacuacccaacuguccccugucaacaucugcaccuucagaggggaugucauccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccucaacaaugggugcucccaaguuacucaggcagaaacauucauaaugugcaccuggcccccgcuguagcccccacuuucccgggcgagcagcuccucuucuuuagaucuacuaugcccggaugcagcggguaccccaacauggauuuggacugucugcucccccaggagugggugcaguacuucuaccaggaggcagccccagcacaaucugauguggcucuguugagauuugugaauccagacacagguaggguuuuguuugaguguaagcuccauaaaucaggcuauguuacaguggcucacacuggucaacaugauuugguuaucccccccaaugguuauuuuagauuugauuccugggucaaccaguucuacacacuugcccccaugggaaaugggacggggcguagacgugcauuauaa

SEQ ID NO: 4785 - RNA, 1623 nt, Artificial Sequence
  capsid_VP1__Norovirus__ABC96332
augaagauggcgccgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuaggaauaauuuugugcaagccccugguggagaguucacaguauccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccacauaauaguagauguuaggcaauuggaaccuguguugauccccuuaccugauguuaggaauaauuucuaccauuacaaucaaucaaaugauuccaccauuaaauugauagcaaugcuguacacaccacuuagggccaauaaugcuggggaugaugucuucacagucucuugucgaguccucacgaggccaucccccgauuuugauuucauauuucuggugccacccacaguugagucaagaaccaaaccauucaccgucccaauuuuaacuguugaggaaaugaccaauucaagauuccccauuccuuuggaaaaauuguucacgggucccagcagugccuuugucguccaaccacaaaauggcaggugcacgacugauggcgugcucuuaggcacuacccaacugucccccgucagcaucugcaccuucagaggcgaugucacccacauuccagguacucguauuuacagaaugaauuuggcuucucaaaauuggaacaauuaugacccaacagaagaaauuccagccccucugggaacuccagauuucgugggaaagauccaaggcaugcucacccaaaccacaaagggagacggcucgacccgcggucacaaagcuacagugagcacugggaguguugacuucacuccaaagcugggcagcguucaguucgccacugauacagacaaugauuuugaaacuggccaaaacacaagguucaccccagucggugucauccaggaugguaguagugcccacagaaaugaaccccaacaauggguacucccagauuacucagguagaacuguucauaauguacaccuagccccugccguagcccccacuuuuccgggugagcaacuucuuuucuucagaucuacuaugcccggaugcaguggguaucccaauauggauuuggauugucuacucccccaggaauggguacagcacuucuaccaagaggcagccccaucacaaucugacguggcuuugcugagauuugugaauccagacacaggcaggguucuguuugagugcaagcuucauaaagcaggcuaugucacaguggcgcacacuggccagcaugauuugguuaucccccccaauggcuauuuuagauuugauuccugggucaaccaguucuacacacuugcccccaugggaaauggagcggggcguagacgugcauuauaa

SEQ ID NO: 4786 - RNA, 1623 nt, Artificial Sequence
  major_capsid_protein_VP1__Norovirus__ADB27027
augaagauggcgucgaaugacgccaccccaucugauggguccacagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuagguccugauuugaaccccuaccuuucccauuuggccagaauguacaaugguuaugcaggugguuuugaagugcagguaauccucgcggggaacgcguucaccgccggaaaaaucauauuugcagcagucccaccaaacuucccaacugaaggcuugagccccagccaggucacuauguucccccacauaauaguagauguuaggcaacuggaaccuguguugauccccuuacccgauguuaggaauaauuucuaucacuacaaucaaucaaaugaccccaccaucaaauugauagcaauguuguauacaccacuuagggcuaauaaugcuggggacgaugucuucacaguuucuugucggguucucacgagaccaucccccgauuuugauuuuauauuuuuagugccacccacaguugagucaagaacuaaaccauucucugucccaauuuuaacuguugaggagaugaccaauucaagauuccccauuccuuuggaaaaguuguucacgggucccagcagugccuuuguuguucaaccacaaaacggcaggugcacgacugauggcgugcuccuagguacuacccaacugucuccugucaacaucugcaccuucagaggggaugucacccauauugcagguagucguaacuacacaaugaauuuggcuacucaaaacuggaacaguuaugacccaacagaagaaaucccagccccucuaggaacuccagauuucguggggaagauucaaggugugcucacccaaaccacaagggcagacggcucgacccgcggccacaaagcuacaguguacacugggagcgccgauuuuucuccaaaacuggguagaauucaguuugccacugacacagacaaugauuuugaugcuaaccaaaacacaaaguucaccccagucggugucauccaggaugguaauacugcccaucgaaaugaaccccaacaaugggugcucccaaguuacucaggcagaaauagucacaaugugcaccuggcccccgcuguagcccccacuuuuccgggugagcaacuucucuucuucagauccacuaugcccggaugcagcggguaccccaacauggauuuggacugccugcucccccaggaaugggugcaguauuucuaucaagaggcagccccagcacaaucugauguggcucugcuaagauuugugaauccagacacagguaggguuuuguuugaguguaagcuucauaaaacaggcuauguuacaguggcucacaccggccaacaugauuugguuaucccccccaaugguuauuuuagauuugauuccugggucaaccaguucuacacacuugcccccaugggaaauggaacggggcguagacgugcauuauaa

SEQ ID NO: 4787 - RNA, 1626 nt, Artificial Sequence
  major_capsid_protein_VP1__Norovirus__AEE10003
augaggaugagugauggcgcagcgccaaaagccaauggcucugaagccagcggccaggaucuuguuccuaccgccguugaacaggccguccccauucagcccguggcuggugcggcucuugccgcccccgccgccgggcaaaucaaccaaauugaccccuggaucuuccaaaauuuuguccagugcccccuuggugaguuuuccauuucaccucgaaacaccccaggugaaauacuguuugauuuggcccucgggccagggcucaaccccuaccucgcccaccucucagccauguacaccggcuggguugggaacauggagguucagcugguccucgccggcaaugccuuuacugcuggcaaggugguuguugcccuuguaccacccuauuuucccaaagggucacucaccacugcccagaucacaugcuucccacaugucaugugugaugugcgcacccuggagcccauucaacucccucuucuugaugugcgucgaguccuuuggcacgcuacccaggaucaagaggaaucuaugcgccugguuugcaugcuguacacgccacuccgcacaaacagcccgggugaugagucuuuuguggucucuggucgccuucuuucuaagccggcggcugauuucaauuuugucuaccugacuccccccauagagagaaccaucuaccggauggucgacuugcccgugauacagccgcggcugugcacgcacgcacguuggccugccccggucuauggacucuugguggacccaucccuccccucaaacccccaguggcagaauggaagggugcgcguugauggaacccugcuuggcaccacgccagucuccggcucauggguguccugcuuugcagcggaggcugccuaugaguuccaaucaggcaccggcgagguggcgacauucacucugauugagcaggauggaucugccuacguccccggcgacagggcagcaccacucgguuaccccgauuucuccgggcaacuggagaucgagguccagaccgagaccaccaagacuggagacaagcucaagguuaccaccuuugagaugguucuuggcccagagaccaacguggaucaggcccccuaccagggcaggguguacgccagcgucaacgcugcggccucccucgacuugguggauggcaggguucgcgcggucccaagauccgucuacaguuuccaagaugucaucccugaguauaaugauggguugcugguuccccuugcccccccaauuggccccuuucuucccggcgagguucucuugagguuccggaccuacaugcgucagauugacaccacugacgccgcagcagaggcaauagacugugcacucccccaggaguuuaucuccugguucgcgucuaacgcguucaccgugcaguccgaggcccugcuccuuagguacaggaacacccugacugggcaacugcuguuugagugcaagcucuacagcgaagguuacaucgccuuguccuauucugguucaggagcccucaccuucccgaccgauggcuucuuugaggucgucagcugggucccccgucuuuaccaauuggccucugugggaagcuuggcaacaggccgaacacucaaacaauaa

SEQ ID NO: 4788 - RNA, 1626 nt, Artificial Sequence; identical to SEQ ID NO: 4787
  major_capsid_protein_VP1__Norovirus__AEE10006

SEQ ID NO: 4789 - RNA, 1626 nt, Artificial Sequence
  major_capsid_protein_VP1__Norovirus__AEE10009
augaggaugagugauggcgcagcgccaaaagccaauggcucugaggccagcggccaggaucuuguuccuaccgccguugaacaggccguccccauucagcccguggcuggugcggcucuugccgcccccgccgccgggcaaaucaaccaaauugaccccuggaucuuccaaaauuuuguccagugcccccuuggugaguuuuccauuucaccucgaaacaccccaggugaaauacuguuugauuuggcccucgggccagggcucaaccccuaccucgcccaccucucagccauguacaccggcuggguugggaacauggagguucagcugguccucgccggcaaugccuuuacugcuggcaaggugguuguugcccuuguaccacccuauuuucccaaagggucacucaccacugcccagaucacaugcuucccacaugucaugugugaugugcgcacccuggagcccauucaacucccucuucuugaugugcgccgaguccuuuggcacgcuacccaggaucaagaggaaucuaugcgccugguuugcaugcuguacacgccacuccgcacaaacagcccgggugaugagucuuuuguggucucuggucgccuucuuucuaagccggcggcugauuucaauuuugucuaccugacuccccccauagagagaaccaucuaccggauggucgacuugcccgugauacagccgcggcugugcacgcacgcacguuggccugccccggucuauggacucuugguggacccaucccuccccucaaacccccaguggcagaauggaagggugcgcguugauggaacccugcuuggcaccacgccagucuccggcucauggguguccugcuuugcagcggaggcugccuaugaguuccaaucaggcaccggcgagguggcgacauucacucugauugagcaggauggaucugccuacguccccggugacagggcagcaccacucgguuaccccgauuucuccgggcaacuggagaucgagguccagaccgagaccaccaagacuggagacaaacucaagguuaccaccuuugagaugguucuuggcccagagaccaacguggaucaggcccccuaccagggcaggguguacgccagcgucaacgcugcggccucccucgacuugguggauggcaggguucgcgcggucccaagauccgucuacaguuuccaagaugucaucccugaguauaaugauggguugcugguuccccuugcccccccaauuggucccuuucuucccggcgagguucucuugagguuccggaccuacaugcgucagauugacaccacugacgccgcagcagaggcaauagacugugcacucccccaggaguuuaucuccugguucgcgucuaacgcguucaccgugcaguccgaggcccugcuccuuagguacaggaacacccugacugggcaacugcuguuugagugcaagcucuacagcgaagguuacaucgccuuguccuacucugguucaggagcccucaccuucccgaccgauggcuucuuugaggucgucagcugggucccccgucuuuaucaauuggccucugugggaagcuuggcaacaggccgaacacucaaacaauaa

SEQ ID NO: 4790 - RNA, 1626 nt, Artificial Sequence
  major_capsid_protein_VP1__Norovirus__AEE10015
augaggaugagugauggcgcagcgccaaaagccaacggcucugaagccagcggccaggaucuuguuccuaccgccguugaacaggccguccccauucagcccguggcuggugcggcucuugccgcccccgccgccgggcaaaucaaccaaauugaccccuggaucuuccaaaauuuuguccagugcccccuuggugaguuuuccauuucaccucgaaacaccccaggugaaauacuguuugauuuggcccucgggccagggcucaaucccuaccucgcccaccucucagccauguacaccggcuggguugggaacauggagguucagcugguccucgccggcaaugccuuuacugcuggcaaggugguuguugcccuuguaccacccuauuuucccaaagggucacucaccacugcccagaucacaugcuucccacaugucaugugugaugugcgcacccuggagcccauucaacuuccucuucuugaugugcgccgaguccuuuggcacgcuacccaggaucaagaggaaucuaugcgccugguuugcaugcuguacacgccacuccgcacaaacagcccgggugaugagucuuuuguggucucuggucgccuucuuucuaagccggcggcugauuucaauuuugucuaccugacuccccccauagagagaaccaucuaccggauggucgacuugcccgugauacagccgcggcugugcacgcacgcacguuggccugccccggucuauggacucuugguggacccaucccuccccucaaacccccaguggcagaauggaagggugcgcguugauggaacccugcuuggcaccacgccagucuccggcucauggguguccugcuuugcagcggaggcugccuaugaguuccaaucaggcaccggcgagguggcgacauucacucugauugagcaggauggaucugccuacguccccggugacagggcagcaccacucgguuaccccgauuucuccgggcaacuggagaucgagguccagaccgagaccaccaagacuggagacaagcucaagguuaccaccuuugagaugguucuuggcccagagaccaacguggaucaggcccccuaccagggcaggguguacgccagcgucaacgcugcggccucccucgacuugguggauggcaggguucgcgcggucccaagguccgucuacaguuuccaagaugucaucccugaguacaacgacggguugcugguuccccuugcccccccaauuggccccuuucuccccggcgagguucucuugagguuccggaccuacaugcgucagauugacaccacugacgccgcagcagaggcaauagacugugcacucccccaggaguuugucuccugguucgcgucuaacgcguucaccgugcaguccgaggcccugcuccuuagguacaggaacacccugacugggcaacugcuguuugagugcaagcucuacagcgaagguuacaucgccuuguccuauucugguucaggagcccucaccuucccgaccgauggcuucuuugaggucgucagcugggucccccgucuuuaccaauuggccucugugggaagcuuggcaacaggccgaacacucaaacaauaa

SEQ ID NO: 4791 - RNA, 1626 nt, Artificial Sequence
  major_capsid_protein_VP1__Norovirus__AEE10018
augaggaugagugauggcgcagcgccaaaagccaacggcucugaagccagcggccaggaucuuguuccuaccgccguugaacaggccguccccauucagcccguggcuggugcggcucuugccgcccccgccgccgggcaaaucaaccaaauugaccccuggaucuuccaaaauuuuguccagugcccccuuggugaguuuuccauuucaccucgaaacaccccaggugaaauacuguuugauuuggcccucgggccagggcucaaccccuaccucgcccaccucucagccauguacaccggcuggguugggaacauggagguucagcugguccucgccggcaaugccuuuacugcuggcaaggugguuguugcccuuguaccacccuauuuucccaaagggucacucaccacugcccagaucacaugcuucccacaugucaugugugaugugcgcacccuggagcccauucaacucccucuucuugaugugcgucgaguccuuuggcacgcuacccaggaucaagaggaaucuaugcgccugguuugcaugcuguacacgccacuccgcacaaacagcccgggugaugagucuuuuguggucucuggucgccuucuuucuaagccggcggcugauuucaauuuugucuaccugacuccccccauagagagaaccaucuaccggauggucgacuugcccgugauacagccgcggcugugcacgcacgcacguuggccugccccggucuauggacucuugguggacccaucccuccccucaaacccccaguggcagaauggaagggugcgcguugauggaacccugcuuggcaccacgccagucuccggcucauggguguccugcuuugcagcggaggcugccuaugaguuccaaucaggcaccggcgagguggcgacauucacucugauugagcaggauggaucugccuauguccccggugacagggcagcaccacucgguuaccccgauuucuccgggcaacuggagaucgagguucagaccgagaccaccaagacuggggacaagcucaagguuaccaccuuugagaugguucuuggcccagagaccaacguggaucaggcccccuaccagggcaggguguacgccagcgucaacgcugcggccucccucgacuugguggauggcaggguucgcgcggucccaagauccgucuacaguuuucaagaugucaucccugaguauaaugauggguugcugguuccccuugcccccccaauuggccccuuucuccccggcgagguucucuugagguuccggaccuacaugcgucagauugacaccacugacgccgcagcagaggcaauagacugugcacucccccaggaguuuaucuccugguucgcgucuaacgcguucaccgugcaguccgaggcccugcuccuuagguacaggaacacccugacugggcaacugcuguuugagugcaagcucuacagcgaagguuacaucgccuuguccuauucugguucaggagcccucaccuucccgaccgauggcuucuuugaggucgucagcugggucccccgucuuuaccaauuggccucugugggaagcuuggcaacaggccgaacacucaaacaauaa

SEQ ID NO: 4792 - RNA, 1626 nt, Artificial Sequence
  major_capsid_protein_VP1__Norovirus__AEE10021
augaggaugagugauggcgcagcgccaaaagccaacggcucugaagccagcggccaggaucuuguuccuaccgccguugaacaggccguccccauucagcccguggcuggugcggcucuugccgcccccgccgccgggcaaaucaaccaaauugaccccuggaucuuccaaaauuuuguccagugcccccuuggugaguuuuccauuucaccucgaaacaccccaggugaaauacuguuugauuuggcccucgggccagggcucaaccccuaccucgcccaccucucagccauguacaccggcuggguugggaacauggagguucagcugguccucgccggcaaugccuuuacugcuggcaaggugguuguugcccuuguaccacccuauuuucccaaagggucacucaccacugcccagaucacaugcuucccacaugucaugugugaugugcgcacccuggagcccauucaacucccucuucuugaugugcgucgaguccuuuggcacgcuacccaggaucaagaggaaucuaugcgccugguuugcaugcuguacacgccacuccgcacaaacagcccgggugaugagucuuuuguggucucuggucgccuucuuucuaagccggcggcugauuucaauuuugucuaccugacuccccccauagagagaaccaucuaccggauggucgacuugcccgugauacagccgcggcugugcacgcacgcacguuggccugccccggucuauggacucuugguggacccaucccuccccucaaacccccaguggcagaauggaagggugcgcguugauggaacccugcuuggcaccacgccagucuccggcucauggguguccugcuuugcagcggaggcugccuaugaguuccaaucaggcaccggcgagguggcgacauucacucugauugagcaggauggaucugccuauguccccggugacagggcagcaccacucgguuaccccgauuucuccgggcaacuggagaucgagguucagaccgagaccaccaagacuggagacaagcucaagguuaccaccuuugagaugguucuuggcccagagaccaacguggaucaggcccccuaccagggcaggguguacgccagcgucaacgcugcggccucccucgacuugguggauggcaggguucgcgcggucccaagauccgucuacaguuuucaagaugucaucccugaguauaaugauggguugcugguuccccuugcccccccaauuggccccuuucuccccggcgagguucucuugagguuccggaccuacaugcgucagauugacaccacugacgccgcagcagaggcaauagacugugcacucccccaggaguuugucuccugguucgcgucuaacgcguucaccgugcaguccgaggcccugcuccuuagguacaggaacacccugacugggcaacugcuguuugagugcaagcucuacagcgaagguuacaucgccuuguccuauucugguucaggagcccucaccuucccgaccgauggcuucuuugaggucgucagcugggucccccgucuuuaucaauuggccucugugggaagcuuggcaacaggccgaacacucaaacaauaa

SEQ ID NO: 4793 - RNA, 1626 nt, Artificial Sequence
  major_capsid_protein_VP1__Norovirus__AEE10024
augaggaugagugauggcgcagcgccaaaagccaacggcucugaagccagcggccaggaucuuguuccuaccgccguugaacaggccguccccauucagcccguggcuggugcggcucuugccgcccccgccgccgggcaaaucaaccaaauugaccccuggaucuuccaaaauuuuguccaaugcccccuuggugaguuuuccauuucaccucgaaacaccccaggugaaauacuguuugaucuggcccuuggaccagggcucaaccccuaccuugcccaccucucagccauguacaccggcuggguugggaacauggagguucagcugguccucgccggcaaugccuuuacugcuggcaaggugguuguugcccuuguaccacccuauuuucccaaagggucacucaccacugcucagaucacaugcuucccacaugucaugugugaugugcgcacccuggagcccauucaauugccucuucuugacgugcgucgaguucuuuggcaugcuacccaggaucaggaggagucuaugcgccuggucugcaugcuguacacgccacuccgcacaaacagcccgggugaugagucuuuuguggucucuggccgccuucuuucuaagccggcggcugauuucaacuuugucuaccugacuccccccauagagagaaccaucuaccggauggucgaccugcccgugauacagccgcggcugugcacgcacgcacguuggccugccccggucuauggccuguuaguggacccaucccuccccucaaacccccaguggcagaauggaagggugcacguugauggaacccugcuuggcaccaccccaaucuccgguucguggguguccugcuuugcagcggaggcugccuacgaguuccaaucaggcaucggugagguggcgacauucaaccugauugagcaggacggaucugccuacacccccggugauagggcagcaccgcucgguuaccccgacuucuccggucagcuggagaucgagguucagaccgagaccaccaagacuggagauaagcucaaggucaccaccuuugagauggcucuuggcccaaagaccaacguggaucagaccccuuaccagggcagaguguuugccagcaucaccguugcggccucucuugaccugguggauggcaggguucgugcggucccaagauccgucuauggcuuccaagacaccaucccugaauauaacgaugggcugcuggucccccuugcccccccaauugguccuuuucuccccggugaaguccuccugagguuccggaccuacaugcgucagcucgaugccacugacgccgcagcagaggcgauagacugugcacucccccaggaguucgucuccugguucgcguccaacgcguucaccgugcagucugaagcccugcuccuuagguauaggaacacccugaccgggcaacugcuguuugagugcaaacucuacagcgaggguuacaucgcccuguccuacucagggucaggaccccucaccuucccaacugauggcuucuuugaagucguuagcugggucccccgccucuaucaauuggccuccgugggaagcuuggcaacaggccgaacacucaaacaauaa

SEQ ID NO: 4794 - RNA, 1626 nt, Artificial Sequence
  major_capsid_protein_VP1__Norovirus__AEE10027
augaggaugagugauggcgcagcgccaaaagccaacggcucugaggccagcggccaggaucuuguuccuaccgccguugaacaggccguccccauucagcccguggcuggugcggcucuugccgcccccgccgccgggcaaauuaaccaaauugaccccuggaucuuccaaaauuuuguccaaugcccccuuggugaguuuuccauuucaccucgaaacaccccaggugaaauacuguuugauuuggcccucgggccagggcucaaccccuaccuugcccaccucucagccauguacaccggcuggguugggaacauggagguucagcugguccucgccggcaaugccuuuacugcuggcaaggugguuguugcccuuguaccacccuauuuucccaaagggucacucaccacugcucagaucacgugcuucccacaugucaugugugaugugcgcacccuggagcccauucaacucccucuucuugaugugcgucgaguucuuuggcaugcuacccaggaucaggaggagucuaugcgccuggucugcauguuguacacgccacuccgcacaaacagcccgggugaugagucuuuuguggucucuggccgccuucuuucuaagccggcagcugauuuuaacuuugucuauuuaacuccccccauugagaggaccauuuacagaauggucgacuugcccguguugcagccgcggcugugcacgcacgcucguuggccagcuccgguuuacggccucuugguggacccaucccucccauccaauccccaauggcagaauggaagagugcauguugaugggacccuccuuggcacaacaccugucucugguuccuggguuuccugcuuugcagccgaggccgccuacgaguuccagucugggacuggugagguggcgaccuucaccaugauugaacaggaugguuccgccuauguuccuggcgacagggcggcuccccuuggguauccugauuauucugggcagcuagagauugaggugcagacugagaccaccaagacaggagauaagcucagggugaccacuuuugagaugauucuugguccuaccaccaacguggaccaggcccccuaccaggguaaaguguaugcaagcuugucaacuucggccucgcuuaaccugguggacgggagggucagggcgguuccacgcucuguuuauucuuuccaggauguucucccagaguauaaugauggccuuuuagucccccuugccccgccccuaggucccuuucuuccuggugagguuuugcugagguuccggacauacaugcgucagcucgauaccgcugacgccacagcgcagccaauugacugugccuugccccaggaguucaucucuugguucgcaagcaacaauuucacaguucagucggacgcgcuccugaucagguaccggaacacuuugaccggccagcuccuguuugaggcuaagcuuuauagcgagggcuacauugccgugucuuacucagguucugguccccucaccuuucccacugacggcuucuucgagguuguuaguugggucccccgccuuuuccaauuggccucugugggaagcuuggcaacaggccgaacacucaaacaauaa

SEQ ID NO: 4795 - RNA, 1608 nt, Artificial Sequence
  major_capsid_protein_VP1__Norovirus__AGI96385
augaagauggcgucgaaugacgccgcuccaucuaaugauggcgcagccggucucguaccagaggucaacaacgagacgauggcacuugagccgguggcuggggcuuccauagcugccccucuaaccggccaaaauaaugugauagaccccuggauuagaaugaacuuuguccaagcuccaaauggugaauuuacaguguccccccguaauuccccaggugaaguguuguuaaauuuggaauuaggcccugaauuaaauccauucuuggcacaccuuucaagaauguacaaugguuaugcugguggggcugaagugcaggugcuacuugcugggaaugcguucacagcaggaaaacuaguguuugcagcaauccccccacacuucccucuugagaaucugaguccuggucaaauuacaauguuuccccauguaauuauugauguuagaacucuagaaccuguccuuuuaccuuugccagauguuagaaauaauuucuuucauuacaaucagcagccugagccccguaugagacuuguggcuauguuguacacuccucuuagaucuaaugguucuggugaugauguguucacagucucuuguaggguccucacucgccccucuccagacuuugauuuuaauuauuugguccccccaacuguggaaucuaaaaccaaaccauucacccugccaauauuaaccaucggagaauugucaaauucuagguucccaguaccaauagaugaauuguacaccagcccuaaugaaggagugauugugcaaccucaaaauggcagaucaacacucgauggugaacugcuuggcaccacacaacuuguaccaucaaacaucugugccuugcgagggcgcaucaacgcccaagugccagacgaucaccaucaauggaacuugcagguuacaaaugcaaaugggacuuccuuugaccccacugaagaugucccuacaccauugggcacgccagauuuccuggcaaacaucuacggagucacuagucagaggaacccugacaacacuugccgugcccaugaugguguuuuggcaaccuggagcccuaaauuuacacccaaguuaggaucugugguuuuggguacuugggaagaaagugaucuugaucucaaucagccuacuagauucacaccuguugguuuguaugauacaaaccacuuugaucaauggauccuacccaacuauucuggaagauugaccuuaaacaugaauuuggcgcccuccguugcuccccucuucccaggugaacaaauacucuucuuuaggucccacauaccacuuaaaggaggcacuuccaacggugccauugacugucuacucccucaggaguggauccagcauuucuaucaggagucagccccgucacccacagauguugcucugauuagguacaccaacccugacacgggccguguccuuuuugaggccaaacuacauagacagggauuuaucacaguagcaaauucugguucuagaccuauuguuguuccuccuaaugguuauuuuagguuugauucuuggguuaaucaguuuuauucucucgcccccaugggaacugggaaugggcguagaagggugcaguaa

SEQ ID NO: 4796 - RNA, 1644 nt, Artificial Sequence
  major_capsid_protein_VP1__Norovirus__AGI96397
augaagauggcgucgaaugacgcugcuccaucgaaugauggugcugccaaccucguaccagaggccaacaaugagguuauggcacuugaaccgguggugggagccucaaucgcagcuccugucgucggccaacaaaacauaauugaccccuggauuagagaaaauuuuguccaagcaccacagggcgaguucaccgucucaccgaggaacucgccuggugagaugcuauuaaaucuugaauuaggcccagaacucaacccuuaucuaagucaccugucccgcauguauaauggguaugcugguggcaugcagguucaggugguccuagcugggaaugcguucacagcugggaaaaucaucuuugccgccguaccaccacauuuucccguagaaaauaucaaugcagcucaaauaaccauguguccccauguaauuguugaugugagacagcuugaaccaguacuucugccccucccugacauaaggaauagguucuuucauuacaaucaggagaacaccucccggaugagacuuguggcuaugcuuuacaccccccugagggccaacucuggugaagauguguuuacuguuuccuguagggucuugacccguccugccccugauuuugaguucacuuucuugguaccaccaacuguugagucaaagacuaaaccuuucucauuacccauacuaacucuuggugagcuaucuaacuccagauucccagccccaauagauauguuguacaccgacccaaaugaggggaucgugguccaaccacaaaaugguaggugcacucuugauggcacuuugcaaggcaccacacaacugguccccacccaaauuugugcuuucaggggcacacuaauuggccaaacaucgagaucuccagacucaaccgacucagccccucggagaagggaucacccacuccaugugcaauuaaagaaccuugauggcacgcaguacgacccaacugaugaagugccagcaguccuuggugccauugacuucaaggggacugucuuugggguggccagccagagagaugugucagggcagcaagugggagcaacucgagcucaugaggugcacaucaacacaaccgauccuagguacacaccaaaacugggauccauucucauguacucagagucggacgacuuugugacuggacagccgguccgcuucacacccauaggaaugggugacaacgacuggcaccagugggagcugccugacuacccuggacaccuaacccugaacaugaaccuugccccagcagucgcuccugcuuuuccgggcgagaggauucuuuucuucaggucaauagucccgucugcugguggcuaugggucuggacaaauagauugccucauaccgcaggaguggguucagcauuucuaccaggaagcugcaccaucccaaucugccguggcacucauuagguaugucaauccugauacaggcagaaacaucuuugaggcuaaauugcacagggaagguuucaucaccguggcaaauucuggcaacaacccuauuguuguccccccuaauggguauuuuagguuugaggcuugggugaaucaauuuuacacuuugacccccaugggaacuggucaggggcguaggagggaucaguaa

SEQ ID NO: 4797 - RNA, 1608 nt, Artificial Sequence
  major_capsid_protein_VP1__Norovirus__AGI96398
augaagauggcgucgaaugacgccgcuccaucuaaugauggcgcagccggucucguaccagaggucaacaacgagacgauggcacuugagccgguggcuggggcuuccauagcugccccucuaaccggccaaaauaaugugauagaccccuggauuagaaugaacuuuguccaagcuccaaauggugaauuuacaguguccccccguaauuccccaggugaaguguuguuaaauuuggaauuaggcccugaauuaaauccauucuuggcacaccuuucaagaauguacaaugguuaugcuggugggguugaagugcaggugcuacuugcugggaaugcguucacagcaggaaaacuaguguuugcagcaauccccccacacuucccucuugagaaucugaguccuggucaaauuacaauguuuccccauguaauuauugauguuagaacucuagaaccuguccuuuuaccuuugccagauguuagaaauaauuucuuucauuacaaucagcagccugagccccguaugagacuuguggcuauguuguacacuccucuuagaucuaaugguucuggugaugauguguucacagucucuuguaggguccucacucgccccucuccagacuuugauuuuaauuauuugguccccccaacuguggaaucuaaaaccaaaccauucacccugccaauauuaaccaucggagaauugucaaauucuagguucccaguaccaauagaugaauuguacaccagcccuaaugaaggagugauugugcaaccucaaaauggcagaucaacacucgauggugaacugcuuggcaccacacaacuuguaccaucaaacaucugugccuugcgagggcgcaucaacgcccaagugccagacgaucaccaucaauggaacuugcagguuacaaaugcaaaugggacuuccuuugaccccacugaagaugucccugcaccauugggcacgccagauuuccuggcaaacaucuacggagucacuagucagaggaacccugacaacacuugccgugcccaugaugguguuuuggcaaccuggagcccuaaauuuacacccaaguuaggaucugugguuuuggguacuugggaagaaagugaucuugaucucaaucagccuacuagauucacaccuguugguuuguaugauacaaaccacuuugaucaauggauccuacccaacuauucuggaagauugaccuuaaacaugaauuuggcgcccuccguugcuccccucuucccaggugaacaaauacucuucuuuaggucccacauaccacuuaaaggaggcacuuccaacggugccauugacugucuacucccucaggaguggauccagcauuucuaucaggagucagccccgucacccacagauguugcucugauuagguacaccaacccugacacgggccguguccuuuuugaggccaaacuacauagacagggauuuaucacaguagcaaauucugguucuagaccuauuguuguuccuccuaaugguuauuuuagguuugauucuuggguuaaucaguuuuauucucucgcccccaugggaacugggaaugggcguagaagggugcaguaa

SEQ ID NO: 4798 - RNA, 1608 nt, Artificial Sequence
  major_capsid_protein_VP1__Norovirus__AGI96399
augaagauggcgucgaaugacgccgcuccaucuaaugaugacgcagccggucucguaccagaggucaacaacgagacgauggcacuugagccgguggcuggggcuuccauagcugccccucuaaccggccaaaauaaugugauagaccccuggauuagaaugaacuuuguccaagcuccaaauggugaauuuacaguguccccccguaauuccccaggugaaguguuguuaaauuuggaauuaggcccugaauuaaauccauucuuggcacaccuuucaagaauguacaaugguuaugcuggugggguugaagugcaggugcuacuugcugggaaugcguucacagcaggaaaacuaguguuugcagcaauccccccacacuucccucuugagaaucugaguccuggucaaauuacaauguuuccccauguaauuauugauguuagaacucuagaaccuguccuuuuaccuuugccagauguuagaaauaauuucuuucauuacaaucagcagccugagccccguaugagacuuguggcuauguuguacacuccucuuagaucuaaugguucuggugaugauguguucacagucucuuguaggguccucacucgccccucuccagacuuugauuuuaauuauuugguccccccaacuguggaaucuaaaaccaaaccauucgcccugccaauauuaaccaucggagaauugucaaauucuagguucccaguaccaauagaugaauuguacaccagcccuaaugaaggagugauugugcaaccucaaaauggcagaucaacacucgauggugaacugcuuggcaccacacaacuuguaccaucaaacaucugugccuugcgagggcgcaucaacgcccaagugccagacgaucaucaucaauggaacuugcagguuacaaaugcaaaugggacuuccuuugaccccacugaagaugucccugcaccauugggcacgccagauuuccuggcaaacaucuacggagucacuagucagaggaacccugacaacacuugccgugcccaugaugguguuuuggcaaccuggagcccuaaauuuacacccaaguuaggaucugugguuuuggguacuugggaagaaagugaucuugaucucaaucagccuacuagauucacaccuguugguuuguaugauacaaaccacuuugaucaauggauccuacccaacuauucuggaagauugaccuuaaacaugaauuuggcgcccuccguugcuccccucuucccaggugaacaaauacucuucuuuaggucccacauaccgcuuaaaggaggcacuuccaacggugccauugacugucuacucccucaggaguggauccagcauuucuaucaggagucagccccgucacucacagauguugcucugauuagguacaccaacccugacacgggccguguccuuuuugaggccaaacuacauagacagggauuuaucacaguagcaaauucugguucuagaccuauuguuguuccuccuaaugguuauuuuagguuugauucuuggguuaaucaguuuuauucucucgcccccaugggaacugggaaugggcguagaagggugcaguaa

SEQ ID NO: 4799 - RNA, 1617 nt, Artificial Sequence
  major_capsid_protein_VP1__Norovirus__AGJ52175
augauggcgucuaaggacgcuccaacauccccugauggcgcuaguggcgccggccagcugguaccggaggcuaauacagcugagcaaaucucaauggacccuguugcgggugcuucaacagcagucgcaacggcugggcaaguuaacaugauugacccauggaucuucaauaacuuuguccaagcgccccaaggagaauucacuauuuccccuaauaauacccccggugauauuuuguuugaucuacaacuaggaccccaucuuaacccauuucuagcccaucucucacagauguauaaugguugggucggcaauaugcgugugcgcauauuguuggccggcaacgccuucacagcuggaaagauaaucauuugcuguguccccccuggcuuugaugcuagaauacucacaauagcucaagcaacucucuucccacauuugauugcugacguuaggacccuugagccuguggagcuuccuuuggaggacguacgcaacguucucuaccacaacaguagccagccgcagccaacaaugcggcugguugcuauguuguauaccccccuccgcacugguggugguucuggaggcacugaugccuuugugguggcgggcagggugcuuacgugccccgccccugacuuuagcuuuuuguuucuuguucccccuuccguugaacaaaagaccagaguuuuuaguguccccaauauaccucugaaagaucucucaaauucucgugucccugugccuauacagggcauguuuauguccccagauguuaaucagucaguccaguuucaaaacgggcgcugccaaauugauggucaacuccagggcaccaccccagucucgcucagccaacucugcaagauuagggguaaaacuucaagcaaugccagggugcucaacuugagugagguagaugguacacccuucaucccccuugaaucaccagcgccaguagguuuucccgacuuaggaggcugugacuggcacguaaauuucucuuuccagacucaagaucgggacccaucucaaagugugaccuuugcaaccaaugaugccagcuuuguucccuaccuagguagugucuccccucacaauggggaagguuuucaagcaggcgacaucauagguagccuuggguggauuucagccccgucugauaauucacaauuuaauguuugggcaauaccaaaguauggaucuagucuccagaugucacccaucuugcuccugcuguguucccccaggcuuugggaggugauccuauauuucuacuccaccuucccagguucuggacaacccagucaacuucaagucccauguuuguuaccucaggaguucaucacccacuucugcaacgaacaggcucccaucgcuggggaggcugcccuccuccacuacguggacccugacacggggcgaaacuugggggaauucaaacuuuauccugauggauuuaugaccugugucccuaauaguguuagcaguggcccucaaacccuucccauuaauggagucuuugucuuuguuucauggguauccagauucuaucaacucaagccugugggaacggccucagcggcuagaaggcuuggauugcggcguauauaa

SEQ ID NO: 4800 - RNA, 1641 nt, Artificial Sequence
  major_capsid_protein_VP1__Norovirus__AGX01092
augaugauggcgucuaaggacgccccucaaagcgcugauggcgcaagcggcgcaggucaacuggugccggagguuaauacagcugaccccuuacccauggaaccuguggcugggccaacaacagccguagccacugcugggcaaguuaauaugauugaucccuggauuguuaauaauuuuguccagucaccucaaggugaguucacaaucucuccuaacaauacccccggugauauuuuguuugauuuacaauuagguccacaucuaaacccuuucuugucacauuugucccaaauguauaauggcuggguugggaacaugagagucagaauucuccuugcugggaaugcauucucagcuggaaagauuauaguuuguuuuguccccccuggcuuuacaucuucuucucucaccauagcucaggcuacauuguuuccccauguaauugcugaugugagaacccuugagccaauagaaaugccccucgaggauguacgcaauguccucuaucacaccaaugauaaucaaccaacaaugcggcugguguguaugcuauacacgccgcuccgcacugguggggggucugguaguucugauuccuuuguaguugcuggcaggguucucacagccccuaguagcgacuucaguuucuuguuccuugucccgccuaccauagagcagaagacucgggcuuucacugugccuaauauccccuugcaaaccuuguccaauucuagguuuccuucccucauccaggggaugauucugucccccgaugcaucucaagugguccaauuccaaaaugggcguugccuuauagauggucaacucuuaggcacuacacccgcuacaucaggacagcuguucagaguaagaggaaagauaaaucagggagcccgcacacuuaaccucacagagguggaugguaaaccauucauggcauuugauuccccugcaccugugggguuccccgauuuuggaaaaugugauuggcacaugagaaucagcaaaaccccaaacaacacaaguucaggugaccccaugcgcagugucagcgugcaaaccaaugugcaggguuuugugccacaccugggaaguauacaauuugaugaaguguuuaaucaucccacaggugacuacauuggcaccauugaauggauuucccagccaucuacacccccugggacagauauuaaucugugggagauccccgauuauggaucaucccuuucccaagcagcuaaucuggcccccccaguauuccccccuggauuuggugaggcccuuguauacuuuguuucugcuuucccgggccccaauaaccgcucagccccgaaugauguacccugucuucucccucaagaguacauaacccacuuugucagugaacaagccccaacgaugggugacgcagcuuuacugcauuaugucgacccugauaccaacaggaaccuuggggaguucaagcuauacccuggagguuaccucaccuguguaccaaacgggguaggugccgggccucaacagcucccucucaaugguguuuuucucuuuguuucuugggugucucguuuuuaccagcuuaagccugugggaacagccaguacggcaagagguaggcuuggaguacgccguauauaa

SEQ ID NO: 4801 - RNA, 1647 nt, Artificial Sequence
  major_capsid_protein_VP1__Norovirus__AGX01095
augaagauggcgucgaaugacgcugcuccaucuaaugauggugcugccggccucgucccagagaucagcagugaggcaauggcgcuagaaccaguggcgggugcagcgauagcagcaccccucacuggucagcagaauauaauugaucccuggauuaugaauaauuuugugcaagcaccugguggugaguuuacaguaucuccuagaaauuccccuggugaaguucuucucaauuuggaauuggguccagaaauaaaucccuauuuggcccaucuugcuagaauguauaaugguuaugcagguggauuugaaguacaggugguccuagcuggaaaugcguuuacagcaggaaagauaaucuuugcagcuauucccccuaauuuuccaauugauaaucuaagugcagcacagaucacaauguguccacaugugauuguggaugucaggcagcuggaaccagucaaccucccgaugccugacguccgcaauaacuucuuccauuacaaucaagggucugauucgagauugcgccuaauugcaaugcuauauacaccucuuagggcaaauaauucuggggacgauguuuuuacugugucuugcagagugcuaacuagaccuagcccugacuucucauuuaauuuucuugugccacccacuguggagucaaagacaaaacccuuuucccucccuauucugacuaucuccgaaauguccaauucuagguucccaguaccaauugauucuuugcacaccagcccuacugagaacauuguuguccagugucagaaugggcgagucacccuugauggugaguugaugggcaccacccaacucuuaccuagccaaaucugugcuuucaggggcacgcucaccagaucaacaagcagggccagugaccaggcugauacagcaaccccuagauuguuuaauuauuauuggcauauacaauuggauaaccuaaauggaacuccuuaugacccugcagaagauauaccagccccccuagggacaccagauuuccgggguaaagucuuuggcguggccagccagagaaauccugacgccacgacuagggcacaugaagcaaagauagacacaacaucuggccgcuucaccccaaaacuagguucacuagagauuuccacugagucuggagauuuugaccaaaaccaaccaacaagauucaccccaguuggcauugggguugaccaugagccagauuuucaacaaugggcucuucccgacuaugcaggccaguucacccacaacaugaacuuagccccagcuguugcucccaacuucccuggugagcagcuccuuuucuuccgcucacaguugccaucuucuggugggcgguccaacgggauucuagacugccuggucccccaagaaugggugcagcauuucuaccaagaaucagcccccucccaaacucaaguggcccuaguuagguaugucaacccugacacugguagaguguuauuugaggccaaguugcacaaauuacguuucaugacuauagccaagaguggugacuccccaauaacuguccccccaaauggauacuuuagguuugaaucuugggugaaccccuuuuauacacuugcccccaugggaacugggaaugggcguagaaggauucaauaa

SEQ ID NO: 4802 - RNA, 1623 nt, Artificial Sequence
  major_capsid_protein_VP1__Norovirus__AGX01098
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccaucuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccacauaguaguagauguuaggcaacuagaaccuguguugauucccuuacccgauguuaggaauaauuuuuaucacuacaaucaaucaaaugaccccaccauuaaguugauagcaauguuguacacaccacuuagggccaauaaugcuggggaugaugucuucacaguuucuugccgaguucucacgagaccaucccccgacuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggagcuccagauuuuguggggaagauucaaggcgugcucacccaaaccacaaggacagauggcucaacacgcggccacaaagcuacaguguacacugggagcgccgauuuugcuccaaaacuggguagaguucaauuugaaacugacacagaccaugauuuugaaguuaaccaaaacacaaaguucaccccaguuggugucauccaagaugguggcaccacccaccgaaaugaaccccaacagugggugcucccaaguuacucaggcaggaauacuccuaaugugcaucuggcccccgcuguagcccccacuuuuccgggugagcaacuucucuucuucagauccaccaugcccggauguagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacaauggccaacaugauuugguuaucccccccaaugguuauuuuagguuugauuccugggucaaccaguuuuacacgcuugcccccaugggaaauggaacggggcguagacgugcacuauaa

SEQ ID NO: 4803 - RNA, 1623 nt, Artificial Sequence
  major_capsid_protein_VP1__Norovirus__AKI30060
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccgcucagaucuaauggcucaggugaugaugucuuuacugucucuugcaggguuuugacuaggccuacuccugauuuugaguucacuuauuuagugccaccuucuguugaaucuaaaacuaagccuuuuucuuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucuaucaaucuuagaauuagugacaaugaugauuuccaauuccagccgacaaaauucacaccagugggcgucaaugaugacgaugauggccacccguucagacaaugggaauuaccaaacuauucaggggagcuuaccuugaauaugaaucuugcccccccaguugcuccaaauuucccuggugaacaauuguuauucuuuagaucuuucgugccaugcucaggagguuacaaccaagguauuauagauugucuuauuccccaagaauggauccaacacuucuaucaggaaucagcacccucccagucagacguggcccuaaucagguaugucaacccugauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 4804 - RNA, 1626 nt, Artificial Sequence
  major_capsid_protein_VP1__Norovirus__BAQ94514
augaagauggcgucgaaugacgccgcuccaucuaaugauggugcagcuagucucguaccagaggccauuaaugagacuaugccauuggaacccguugcuggugcaucuauugcugccccaguggcgggacaaaccaacauaauugaccccuggauaagaacaaauuuuguacaagccccuaauggagaguuuacagugucaccaagaaauuccccuggagagauuuuauugaauuuagaauuaggaccagauuugaaucccuacuugucccaucuuucaagaauguauaaugguuaugcuggggguguugaagugcaagugcuccuugcugggaacgcguucacagcagguaagauauuguuugcagcaaucccaccuaacuuuccuguagauaugauuagcccagcucaaaucacuaugcuuccccacuugauuguagauguuaggacuuuggaaccaauuaugauacccuugccugauguuaggaauguguuuuaucauuuuaauaaucaaccucaaccuagaaugagauuaguggcuaugcucuauaccccauugaggucuaaugguucaggggaugaugucuucacugugucuuguagaguauuaacuagaccaacuccugauuuugaauuuuucuaucuggugcccccuucuguagaaucuaaaacuaaaucauuuacacuaccaauacuaaccauuucugaaaugaccaauucccgguuccccauuccaauugagcaauuguauacugcuccaaaugagaccaauguuguccagugucagaauggcaggugcaccuuggauggagagcuccagggcacaacccagcugcuaucaagugcaauuuguucauacaggggcaggacuuuggcuaauaaugauaguugggaccagaaucuacuccagcuguccuauccaaauggugcaagcuaugaccccacugaugaaguaccagcaccauuaggcacucaagauuuuagugggauauuguauggaguguugacccaggacaaugugacugaaggcacaggagaggccaaaaaugcuaagggaauauacauauccaccacuaguggcaaauucaccccaaagauugggucaauuggauugcauucaauaacuggagaugugcaccacaaccaacagucacgguucacccccguuggaaucgccgugaaugagaauacccccuucaaacaauggguccugccacacuauucagguagccuugcucucaacaccaauuuggcaccugcuguugccccgacuuuuccuggugagcaauuguuguucuuuaggucccguguuccauguguccaaggccuacaugggcaggaugcuuucauagauugccuccugccucaagaaugggugaaucacuuuuaccaagaggcagccccuucccaaacagaugucgcccuuauuagguuugucaacccugauaccggucgcacgcuguuugaagccaaacugcauagaucagguuucaucacugugucacauacugguaauuacccucuuguaauccccccaaauggucauuuuagguuugauucuuggguuaaucaauuuuacucacucgcccccaugggaacuggcaaugggcguagaaggauccaguaa

SEQ ID NO: 4805 - RNA, 1626 nt, Artificial Sequence
  major_capsid_protein_VP1__Norovirus__BAQ94516
augaagauggcgucgaaugacgccgcuccaucuaaugauggugcagcuagucucguaccagaggccauuaaugagacuaugccauuggaacccguugcuggugcaucuauugcugccccaguggcgggacaaaccaacauaauugaccccuggauaagaacaaauuuuguacaagccccuaauggagaguuuacagugucaccaagaaauuccccuggagagauuuuauugaauuuagaauuaggaccagauuugaaucccuacuugucccaucuuucaagaauguauaaugguuaugcuggggguguugaagugcaaguacuccuugcugggaacgcguucacagcagguaagauauuguuugcagcaaucccaccuaacuuuccuguagauaugauuagcccagcucaaaucacuaugcuuccccacuugauuguagauguuaggacuuuggaaccaauuaugauacccuugccugauguuaggaauguguuuuaucauuuuaauaaucaaccucaaccuagaaugagauuaguggcuaugcucuauaccccauugaggucuaaugguucaggggaugaugucuucacugugucuuguagaguauuaacuagaccaacuccugauuuugaauuuuucuaucuggugcccccuucuguagaaucuaaaacuaaaccauuuacacuaccaauacuaaccauuucugaaaugaccaauucccgguuccccauuccaauugagcaauuguauacugcuccaaaugagaccaauguuguccagugucagaauggcaggugcaccuuggauggagagcuccagggcacaacccagcugcuaucaagugcaauuuguucauacaggggcaggacuuuggcuaauaaugauaguugggaccagaaucuacuccagcuguccuauccaaauggugcaagcuaugaccccacugaugaaguaccagcaccauuaggcacucaagauuuuagugggauauuguauggaguguugacccaggacaaugugacugaaggcacaggagaggccaaaaaugcuaagggaauauacauauccaccacuaguggcaaauucaccccaaagauugggucaauuggauugcauucaauaacuggagaugugcaccacaaccaacagucacgguucacccccguuggaaucgccgugaaugagaauacccccuucaaacaauggguccugccacacuauucagguagccuugcucucaacaccaauuuggcaccugcuguugccccgacuuuuccuggugagcaauuguuguucuuuaggucccguguuccauguguccaaggccuacaugggcaggaugcuuucauagauugccuccugccucaagaaugggugaaucacuuuuaccaagaggcagccccuucccaaacagaugucgcccuuauuagguuugucaacccugauaccggucgcacgcuguuugaagccaaacugcauagaucagguuucaucacugugucacauacugguaauuacccucuuguaauccccccaaauggucauuuuagguuugauucuuggguuaaucaauuuuacucacucgcccccaugggaacuggcaaugggcguagaaggauccaguaa

SEQ ID NO: 4806 - RNA, 1629 nt, Artificial Sequence
  major_capsid_protein_VP1__Norovirus__BAQ94520
augaagauggcgucgaaugacgccgcuccaucaaaugauggugcagcuagucucguaccagaggccauuaaugagacuaugccauuggaacccguugcuggcgcaucuauugcugccccaguggcgggacaaacuaacauaauugaccccuggauaagaacaaauuuugugcaagccccuaauggagaguuuacaguaucaccaagaaauuccccuggagagauuuuauuaaauuuagaguuaggaccggauuuaaacccuuauuuggcccacuuaucaagaauguacaaugguuaugcuggagguguugaggugcaagugcuccuugcugggaacgcguucacagcaggcaagauacuauuugcagcaaucccacccaacuuuccuguagauaugauuagcccagcucaaaucacuaugcuuccccacuugauuguagauguuaggacuuuggagccuauuaugauacccuuaccugauguuaggaauguguucuaucauuuuaacaaucaaccucaaccaaggaugagauuaguggcuaugcucuacaccccauugagaucuaaugguucaggagaugaugucuuuacugugucuuguagagugcugacuaggccaaccccugacuuugaauucauuuaccuagugccccccucuguggagucuaagacuaaaccauucacacuuccaauauugaccauuucugagcuaaccaacucccgguuccccaucccaauugagcaacuguacacggccccaaaugagaauaauguuguacagugucaaaauggcaggugcaccuuggauggagagcuucagggcaccacccagcugcuaucaagugcaguuugcucuuacaggggaaggacuguggccaacaguggagacaauugggaccagaacuugcuccagcugaccuacccaaguggugcaagcuaugaccccacugacgaaguaccagcacccuugggcacccaggauuucagugggauauuguaugggguguuaacccaagacaauguuagugagagaacaggggaggccaaaaaugcuaagggaauauacauaucuaccaccaguggaaaauucaccccaaaaauugguucaauaggauugcauucaauaacugaaaaugugcaccccaaucaacaaucacgguucacccccguuggagucgcucagaaugagaacacccccuuccagcaauggguucuaccacacuacgcaggugcucucgcucuaaacaccaauuuggcacccgcuguugccccgacuuucccuggugagcaauuacuguucuucaggucccguguuccauguguucaaggccugcaggggcaggaugcuuucauagauugucuccugccucaagagugggugaaucauuuuuaccaagaggcugcuccuucccaagcagacguugcccuuaucagguaugucaacccugauacuggucgcacgcuguuugaggccaaauugcacagaucagguuuuauuacugugucacacacuggugccuacccucuuguggucccuccaaauggucauuucagguuugauucuuggguuaaccaauucuacucacucgcccccaugggaacuggcaaugggcguagaagaguucaauaa

SEQ ID NO: 4807 - RNA, 1629 nt, Artificial Sequence
  major_capsid_protein_VP1__Norovirus__BAQ94524
augaagauggcgucgaaugacgccgcuccaucaaaugauggugcagcuagucucguaccagaggccauuaaugagacuaugccauuggaacccguugcuggcgcaucuauugcugccccaguggcgggacaaacuaacauaauugaccccuggauaagaacaaauuuugugcaagccccuaauggagaguuuacaguaucaccaagaaauucuccuggagagauuuuauuaaauuuagaguuaggaccggauuuaaauccuuauuuggcccacuuaucaagaauguacaaugguuaugcuggagguguugaggugcaagugcuccuugcugggaacgcguucacagcaggcaagauacuauuugcagcaaucccacccaacuuuccuguagauaugauuagcccagcucaaaucacuaugcuuccccacuugauuguagauguuaggacuuuggagccuauuaugauacccuuaccugauguuaggaauguguucuaucauuuuaacaaucaacaucagccuaggaugagauuaguggcuaugcucuacaccccauugagaucuaaugguucaggagaugacgucuuuacugugucuuguagagugcugacuaggccaaccccugacuuugaauucauuuaccuagugccccccucuguggaguccaagacuaaaccauucacacuuccaauauugaccauuucugagcuaaccaacucccgguuccccaucccaauugagcaacuguacacggccccaaaugagaauaauguuguacagugucaaaauggcaggugcaccuuggauggagagcuucagggcaccacccagcugcuaucaagugcaguuugcucuuacaggggaaggacuguggccaacaguggagacaauugggaccagaacuugcuccagcugaccuacccaaguggugcaagcuaugaccccacugacgaaguaccagcacccuugggcacccaggauuucagugggauauuguaugggguguuaacccaagacaauguuagugagagaacaggggaggccaaaaaugcuaagggaauauacauaucuaccaccaguggaaaauucaccccaaaaauugguucaauaggauugcauucaauaacugaaaaugugcaccccaaucaacaaucacgguucacccccguuggagucgcucagaaugagaacacccccuuccagcaauggguccuaccacacuacgcaggugcucucgcucuaaacaccaauuuggcacccgcuguugccccgacuuucccuggugagcaauuacuguucuucaggucccguguuccauguguacaaggccugcaggggcaggaugcuuucauagauugucuccugccccaagagugggugaaucauuuuuaucaagaggcugcuccuucccaagcagacguugcccuuaucagguaugucaacccugauacuggucgcacgcuguuugaggccaaauugcauagaucagguuuuauuacugugucacauacuggugccuacccucuuguggucccuccaaauggccauuucagguuugacucuuggguuaaccaauuuuacucacucgcccccaugggaacuggcaaugggcguagaagaguucaauaa

SEQ ID NO: 4808 - RNA, 1629 nt, Artificial Sequence
  major_capsid_protein_VP1__Norovirus__BAQ94526
augaagauggcgucgaaugacgccgcuccaucaaacgacggugcagcuagucucguaccagaggccauuaaugagacuaugccauuggaacccguugcuggcgcaucuauugcugccccaguggcgggacaaacuaacauaauugaccccuggauaagaacaaacuuugugcaagccccuaauggagaguuuacaguaucaccaagaaauuccccuggagagauuuuauuaaauuuagaguuaggaccggauuuaaauccuuauuuggcccacuuaucaagaauguacaaugguuaugcuggagguguugaggugcaaguucuccucgcugggaacgcguucacagcaggcaagauacuauuugcagcaaucccacccaacuuuccuguggauaugauuagcccagcucaaaucacuaugcuuccccacuugauuguagauguuaggacuuuggagccuauuaugauacccuuaccugauguuaggaauguguucuaucauuucaacaaucaaccucaaccuaggaugagauuaguggcuaugcucuacaccccauugagaucuaaugguucaggagaugaugucuuuacugugucuuguagagugcugacuaggccaaccccugacuuugaauucauuuaccuagugccccccucuguggaguccaagacuaaaccauucacacuuccaauauugaccacuucugagcuaaccaacucccgguuccccaucccaauugagcaacuguacacggccccaaaugagaauaauguuguacagugccaaaauggcaggugcaccuuggauggagagcuucaggguaccacccagcugcuaucaagugcaguuugcucuuacaggggaaggacuguggccaacaguggagacaauugggaccagaacuugcuccagcugaccuacccaaguggcgcaagcuaugaccccacugacgaaguaccagcacccuugggcacccaggauuucagugggauauuguauggggugcuaacccaagacaauguuagugagagaacaggggaggccaaaaaugcuaagggaauauacauauccaccaccaguggaaaauucaccccaaaaauugguucaauaggauugcauucgauaacugaaaaugugcaccccaaucaacaaucacgguucacccccguuggagucgcucagaaugagaacacccccuuccagcaauggguucuaccacacuacgcaggugcucucgcucuaaacaccaauuuggcacccgcuguugccccgacuuucccuggugagcaauuacuguucuucaggucccguguuccauguguucaaggccugcaggggcaggaugcuuucauagauugucuccugccucaagagugggugaaucauuuuuaucaggaggcugcuccuucccaagcagacguugcccuuaucagguaugucaacccugauacuggucgcacgcuguuugaggccaaauuacacagaucagguuuuauuacugugucacauacuggugccuacccucuuguggucccuccaaaugguuauuucagguuugauucuuggguuaaccaauucuacucacucgcccccaugggaacuggcaaugggcguagaagaguucaauaa

SEQ ID NO: 4809 - RNA, 1587 nt, Artificial Sequence
  VP1_capsid_protein__Norovirus__ACV89840
augaugauggcgucgagugacgccacucccccuucugaaggggccaccaaucugguuccagaggucaacacucagguggucccguuagagcccguugcgggugcagcugccgccgcaccuuuuacgggccaaaacaacguuauugaccccuggauauuucaaaauuuugugcaagcuccccagggagaguucaccguuuccccccgcaauacccccggugagauucuccugagaauaccauuaggccccaaucucaauccuuuucuugcacauuugucccgcauguauaaugccuggguggguggcauggaggccgagaugauauuggcugggaaugcguuuacagcuggaaaacucuugauuguggcccuccccccugguuuugaagcgacccaguugaccccggcccaagccacggccuucccucaugucaucgccgauguuaggacccuugagcccauuccaauuccauugccugacaucagaaauguucuguuccauuacaauggugaucccaccccaaccauacagauuguugucaugcuguacaccccacucaggaccaauggcaacggggaugauguguucacagugucuggccgucugcucacccgcccggcaccggauuucuccuucuccuuccugguuccacccacgguggagcagaaaacccgaucauucaccuugcccaaccuugcgguuucagaucuguccaauuccagauuuccagccccuguaaauauucugagggccgaucccaacaccacucuggcccucgauuaucagaaugggaggugcacgcuggauggcgcgcuccagggcacgacccccaccaacuccaguuuccugggguaccuaaggggcacuguggaccgggugaauuccgaucagguccacguccacuugagggagcccaacggugaccccuuccaacucgggcuuccuggcccccagggaguuccagacuaccgggccacccuugacaucuacguggacugggagaacaagaaucauggcaauccaugugagggcacccucaacacaggcucgcagacugaguacaccccugguuuaggcacccucaccuucaauaagaccucgggugacaccccugagcaaggggacccugucauaaugagauuggucgccuucagauccaaccugacagaucaacugccugccuacaauggggccuuuggucagggcgaaaaucuggcccccccgguuucuccuccagugcccggugaagucuucuugcaguuuggcucgcgcuacacgaggcucggugagcgcgagcuugcugugcagugucuccucccaagugaguggauaacacacuucuacucagaggcagccccaauccagggcgaggccaugcugcucagguaugugcaacccgaucugggcaggauccucuuugaggccaaacucuacaaggaggguuuugucaccguugcugguggaaccaacccagucaccuuuccaauugauggcacauucgucgccgucuccuggguuucccgcaacuuuguucucagccccaugggaagcggccaaggccguagaagggccgcccucgcggaguaa

SEQ ID NO: 4810 - RNA, 1587 nt, Artificial Sequence
  VP1_capsid_protein__Norovirus__ACV89843
augaugauggcgucgagugacgccacucccccuucugaaggggccaccaaucugguuccagaggucaacacucagguggucccguuagagcccguugcgggugcagcugccgccgcaccuuuuacgggccaaaacaacguuauugaccccuggauauuucaaaauuuugugcaagcuccccagggagaguucaccguuuccccccgcaauacccccggugagauucuccugagaauaccauuaggccccaaucucaauccuuuucuugcacauuugucccgcauguauaaugccuggguggguggcauggaggccgagaugauauuggcugggaaugcguuuacagcuggaaaacucuugauuguggcccuccccccugguuuugaagcgacccaguugaccccggcccaagccacggccuucccucaugucaucgccgauguuaggacccuugagcccauuccaauuccauugccugacaucagaaauguucuguuccauuacaauggugaucccaccccaaccauacagauuguugucaugcuguacaccccacucaggaccaauggcaacggggaugauguguucacagugucuggccgucugcucacccgcccggcaccggauuucuccuucuccuuccugguuccacccacgguggagcagaaaacccgaccauucaccuugcccaaccuugcgguuucagaucuguccaauuccagauuuccagccccuguaaauauucugagggccgaucccaacaccacucuggcccucgauuaucagaaugggaggugcacgcuggauggcgcgcuccagggcacgacccccaccaacuccaguuuccugggguaccuaaggggcacuguggaccgggugaauuccgaucagguccacguccacuugagggagcccaacggugaccccuuccaacucgggcuuccuggcccccagggaguuccagacuaccgggccacccuugacaucuacguggacugggagaacaagaaucauggcaauccaugugagggcacccucaacacaggcucgcagacugaguacaccccugguuuaggcacccucaccuucaauaagaccucgggugacaccccugagcaaggggacccugucauaaugagauuggucgccuucagauccaaccugacagaucaacugccugccuacaauggggccuuuggucagggcgaaaaucuggcccccccgguuucuccuccagugcccggugaagucuucuugcaguuuggcucgcgcuacacgaggcucggugagcgcgagcuugcugugcagugucuccucccaagugaguggauaacacacuucuacucagaggcagccccaauccagggcgaggccaugcugcucagguaugugcaacccgaucugggcaggauccucuuugaggccaaacucuacaaggaggguuuugucaccguugcugguggaaccaacccagucaccuuuccaauugauggcacauucgucgccgucuccuggguuucccgcaacuuuguucucagccccaugggaagcggccaaggccguagaagggcagcccucgcggaguaa

SEQ ID NO: 4811 - RNA, 1767 nt, Artificial Sequence
  VP1_capsid_protein__Norovirus__AFV48046
augaggcugcagugggaggccuggagaucaacauucccaggcaugcagccacccugcguugggugcgguuugggaccgucacugcugagaccccgcaggaucguacagccauauuuguuaaugaggaugagugaugcuguccaucgcggcaacgccgccgacacccaaggugccucggcaggcgaaggcucaaaucuuguuccuuccaccguugaucaggccauccccauucaacccguggcgggugcggcaauugcugcccccaccgcgggacaagucaaccaaauugacccuuggaucagagaaaauuuuguccagugcccccuuggagaguucaccgucuccccaagaaacacaccaggugagguucuguuuaauuuggcucuuggacccgggcucaaccccuaucuuucacaccucgcugccauguauacaggguggguugggaauauggaaguccaacucguccucgcagguaaugccuuuacugcuggcaaggugguuguugcccuuauuccaccauacuucaacaugcagacacucacaacgucccagaucacgugcuucccgcauaucaugugcgaugugcgaacucuggaaccaauucugcucccucuucuggaugucaggcgcacccucuggcaccccaccaacucagaggaugacacaaugcgccugguaugcaugcucuacaccccacuuaggacuaauucaccuggugaugaaagcuuuguggugucugggaggcuuuuguccagacccucucuggauuucaacuucuuguaccuuacuccaccaauagcucagaccccuuaugagcucccuacaguccccaggauggucccaagcgagaugacucacagccguuggccugcuccaaucuaccaggucguggccgaccccucgcuuguugccaacccccaauggcagaauggccgugucaccauagauggccagcuccuugggaccacgcccauuuccagcacgugggugugcagcauugcagggaccgcugauuacagguacauugcuggaacagacuccuuugaagaaugcaaauuggcccuuucccagcccaacgguucucccuuugugguuggggaugcuccagcccccuauggguacccagauuucaaugccacuaucagcuuuuccuuucagguggaaacuaggcagaacucagccuauucuguuagggaauuuucucucacuaccuccucccagaccauuaaucagagccccuacaccggcacagucuacauggauaggucagaaacucaggauuaccaguaccaggaugacaggauucgaggugugccucauucuguucaaucuuucaaggaucaacucccugacuauguggaaucuggacaacccccaaauuuggccccuccaauugggccauucaugcccggugaggugcuaguucgcuuccgcacauaugugcgucaagaggcgacggcggcucucuaccaggaucaaccaauagauugugcucucccucaggaauuugugacccaucuugcaacccacggcuacacgcugggcucugaugcgcugcuccugcgcuaccgcaaccugcgcaccggacagcucauaugugaggcuaaguuguaugccgaaggguuccuugccaucaguuacuccggcaccggcccucuccagcuccccaccgacgggguguucgagguugucagcuggguucagaggcucuaucagcucgcccccgugggaacuucaacugccgggcgcucucuuggaucauga

SEQ ID NO: 4812 - RNA, 1767 nt, Artificial Sequence
  VP1_capsid_protein__Norovirus__AFV48048
augaggcugcagugggaggccuggagaucaacauucccaggcaugcagccacccugcguugggugcgguuugggaccgucacugcugagaccccgcaggaucguacagccauauuuguuaaugaggaugagugaugcuguccaucgcggcaacgccgccgacacccaaggugccucggcaggcgaaggcucaaaucuuguuccuuccaccguugaucaggccauccccauucaacccguggcaggugcggcaauugcugcccccaccgcgggacaagucaaccaaauugacccuuggaucagagaaaauuuuguccaguguccccuuggagaauucaccgucuccccaagaaacacaccaggugagguucuguuuaauuuggcucuuggacccgggcucaaccccuaucuuucacaccucgcugccauguauacaggguggguugggaauauggaaguccaacucauccucgcagguaaugccuuuacugcuggcaaggugguuguugcccuuauuccaccauacuucaacaugcagacacucacaacaucccagaucacaugcuucccgcauaucaugugcgaugugcgaacuuuggaaccaauucugcucccucuucuggaugucaggcgcacccucuggcaccccaccaacucagaggaugacacaaugcgcuugguaugcaugcucuacaccccacuuaggacuaauucaccuggugaugaaagcuuuguggugucugggaggcuucuguccagacccucuuuggauuucaacuuccuguaccuuacuccaccaauagcucaaacucccuaugaacuccccacaguucccaggaugauuccaagcgagaugacccacagccguuggccugcuccaaucuaccaggucguggcugacccuucucuccuugccaacccucaguggcagaauggccgugucaccauagauggccagcuccuugggaccacgcccauauccaguacuugggugugcagcauugcagggacagcugacuacagguacaucucuggcucagauuccuuugaagagugcaaguuagcccucucucaacccaaugguucccccuuugugguuggagaugccccggcucccuauggguacccagacuucagugcuacuaucagcuucuccuuucagguagagaccaggcagaauucagccuauucuguuagggaguuuucucuuaccaccuccucccagaccaucaaucagagccccuacacuggcacagucuacauggacaggucagaaacccuagauuaccaguaccaggaugacaggauucgaggugugccucauucuguucaugccuucagagaucaacucccugacuauguggaaucuggacaaccuccaaaucuagcucccccaauuggaccauucaugccuggugaggugcuacuucgcuuccgcacauaugugcgccaggaggcgacagcggcccucuaucaggaucaaccaauagauugugcccucccucaggaauuugugacccaucuugcaacccacggcuacacgcugggcucugaugcacugcuccugcgcuaccgcaaucugcgcacugggcagcucauaugugaggcuaagcuguaugccgaaggguuucuugccaucaguuacucugguaccggcccccuucagcuccccaucgaugggguguucgagguggucagcuggguccagaggcucuaucagcucgcccccgugggaacuucgacugcugggcgcucucuugcaucauga

SEQ ID NO: 4813 - RNA, 1623 nt, Artificial Sequence
  VP1_capsid_protein__Norovirus__AGH06682
augaugauggcgucuaaggacgccccaacauccccugauggcgccaguggcgccggccagcugguaccggaggcuaauacagcugagcaaauuucaauggacccuguugcgggugcuucaacagcagucgcgacggcugggcaaguuaauaugauugacccauggauuuuuaauaacuuuguccaggcaccucaaggagaauucacuauuuccccuaauaauacccccggugacauuuuguuugauuuacaacuaggaccccaccuuaauccauuucuagcccaucucucacagauguacaaugguugggucggcaauaugcgugugcgcauacuguuggccgggaaugccuuuacagcuggaaagauaaucauuugcuguguccccccugguuuugaugcuagaauacucacaauagcucaagcaacucuuuucccacacuuaauugcugauguaaggacccuugagccuguggagcuuccuuuggaggaugugcgcaauguucucuuccacaacaguagccaaccgcagccaacaaugcggcugguagcuauguuguacacuccccuccgcacugguggugguuccggaggcacugaugccuuugugguggcggguagggugcuuacgugccccgcccccgacuuuaguuuucuguuucuuguccccccuuccguugaacaaaagaccagaguuuucaguguccccaauauaccccugaaggaucucucaaauucccgugucccugugccuguacagggcauguuuauguccccagauguuaaucagucaguccaguuucagaauggacgcugccaaauugauggccaacuccaaggcacuacuccagucucgcucagccaacucugcaagauuagggguaaaacuucuaguaaugcuagggugcucaacuuaagugagguagauggcacacccuucaucccacuugaaucaccagcgccaguugguuuucccgacuugggagguugugacuggcauguaaauuucacuuuccaggcucaaaaucaggacccaucucaaaguguaaccuuugcaacuaaugaugccagcuuuguccccuaucuagguaguaucucuccucacaaugggggagauuuucaugcaggcgacaucauagguagccuugguuggauuucagccccgucugauaauucacaacuuaauguuuggacaauaccaaaguauggaucuagucucccagaugucacucaucuugccccugcuguguuccccccaggcuuuggggaggugaucuuguacuucuacucuaccuucccggguucuggacaauccagccaacuucaagucccauguuuguugccucaggaguucaucacccacuucuguaacgaacaggcucccaucgcuggggaggccgcccuccuccacuacguggacccugauacggggcgaaacuugggggaauuuaaacuuuacccugauggguuuaugaccuguguccccaauaguguuaguaguggcccucaaacccuuccuaucaauggagucuuugucuuuguuucauggguaucuagauucuaucaacucaagccugugggaacggccucagcggcuagaaggcuuggauugcggcgcauauaa

SEQ ID NO: 4814 - RNA, 1620 nt, Artificial Sequence
  VP1_capsid_protein__Norovirus__AGL98413
augaagauggcgucgagugacgccaacccaucugauggguccgcagccaaccucgucccagaggucaacaaugagguuauggcuuuggagccuguuguuggugcugccauugcagcaccuguagcaggccagcaaaauauaauugaccccuggauuagaaauaauuuuguacaagccccugguggagaauucacaguguccccuagaaacgcuccaggugaaauacuguggagcgcgcccuuaggcccugauuugaaccccuaucucucucaccuguccagaauguacaaugguuaugcaggugguuuugaagugcaaguaauccucgcggggaacgcguucaccgccgggaaagucauauuugcagcaguuccaccaaauuuuccaacugaaggccuaagccccagucagguuacuauguucccccauauaauuguggauguuaggcaauuggaaccuguauugaucccccuaccugauguuaggaauaauuucuaucauuauaaucaagcacaugauuccacccucaaauugauagcaauguuguacacaccacucagagcuaacaaugccggggaugauguuuuuacagucucuugucgaguccucacgagaccauccccugauuuugauuuuauauuccuggugccacccacaguugaaucaagaacuaaaccauuuacugucccaaucuuaacuguugaggaaauguccaauucaagauuccccaucccuuuggaaaagcuguacacggguccuagcagugcuuuuguuguccaaccacaaaauggcagaugcacgacugauggcgugcucuuaggcacuacucagcugucagcugucaacaucugcaacuucaggggggaugucacccguguugggaccagccaugauuauacaaugaauuuggugucccaaaauuggaauaauuaugacccaacagaagaaaucccagcuccccuggggacaccagacuuuguaggaaagauccaagguuugcucacccaaacuacaagagcggacggcucgacccgcgcccacaaggccacagugagcaccgggaguguccacuucacuccaaagcuggguaguguucaauucaccaccgauacggacaaugauuuccaaacuggccaaaacacaaaauuuaccccaguuggugucauccaagacggugaccaccaucagaaugaaccccaacaauggguacucccaaauuacucaggcacaucuggucacaaugugcaucuggccccugccguugcccccgccuucccgggugagcagcuucuuuucuuuagguccacuaugcccggguguagcggguaccccaacaugaauuuggauugccuacucccccaggagugggugcugcacuuuuaccaggaggcagccccagcacaauccgauguggcccugcugagguuugugaacccagacacagguaggguucuguuugagugcaaacuccauaagucaggcuauaucacaguggcucauacuggcccauaugauuugguuaucccccccaaugguuacuucagauuugauucuugggucaaccaguucuacacacucgcccccaugggaaauggaacggggcgcaggcgugcauuauaa

SEQ ID NO: 4815 - RNA, 1620 nt, Artificial Sequence
  VP1_capsid_protein__Norovirus__AGL98414
augaagauggcgucgagugacgccaacccaucugauggguccucagccaaccucgucccagaggucaacaaugagguuauggcuuuggaaccuguuguuggugcugcuauagcagcaccuguggcaggucaacaaaauauaauugaccccuggauuagaaauaauuuugugcaagccccugguggagaguucacaguguccccuagaaacgcuccaggugaaauacuguggagcgcgccucugagcccugauuugaaccccuaucucucucacuuaucuagaauguacaaugguuaugcaggugguuuugaagugcaggugauucuugcggggaaugcguucaccgcgggaaagaucguguuugcugcugucccacccaauuuuccaacugaaggucugagucccagucaagucacaauguuuccucacauaaucguggauguuaggcaauuggaaccugugcugauccccuuaccagauguuagaaauaacuucuaccauuauaaucaagcaaaugauuccacccugaaguugauagcuauguuauacacaccacucagggcuaacaaugccggggaugauguuuucacugucucuugucgaguccuuacaagaccaucuccugacuuugauuuuauuuuccuggucccacccacagucgaaucaagaaccaaaccauucacugucccaguacuuacuguugaagagaugacuaauucaagauuuccuaucccucuagaaagauuauuuacaggccccagcacugcuuuuguuguucagccccaaaauggcagaugcacaacugauggcguccuucuuggcaccacucaguugucggcugucaauaucuguaacuucagaggggaagucaaucacauugccgguacucacgauuacaccaugaggcuaacuucucagaauuggaacaacuaugacccaacagaagagauuccagccccucuugggaccccagacuuuguagggaggauucaaggugugcucacucagaccaccagaagugauggcucgacccgcucccacaaggccacagugagcacggggaguguucacuucacuccaaaauugggcaguguucaguucaccaccgacacaaccaaugaucuuaaugcugggcaaaacacaaaauucaccccggucggugucgagcaaaccagcggcgaccaccaaagugagccucaacaauggacacucccaaauuacucagguacuccaaaucauaaugugcauuuggcccccgcuguugcgcccacuuucccgggugaacagcugcuuuucuuuagguccacucuaccuggguguggcggguacccuaauaugaaucuggacugcuugcucccccaagaguggguuuugcacuucuaccaagaagcugccccagcacaaucugauguggccuugcugagguuuguuaacccagacacaggaagaguguuguuugaauguaagcuccauagaucaggcuucaucacaguggcccacucugguucacaugacuugguuauucccccuaaugguuauuucagauuugauuccuggguuaaucaguuuuacacucucgcccccaugggaaaugggucggggcguagacgggugguauaa

SEQ ID NO: 4816 - RNA, 1617 nt, Artificial Sequence
  VP1_capsid_protein__Norovirus__AGL98416
augaagauggcgucgaaugacgccaacccaucugauggguccgcagccaaccucgucccagaggucaacaaugagguuauggcuuuggagccuguuguuggagcugcuauugcagccccaguggcaggucaacaaaauguaauugaccccuggauuagaaacaauuuugugcaagcccccgguggggaguuuacagugucuccuagaaaugccccaggugaaauauuauggaguaugccuuuaagcccugaauugaaccccuaccuuucacauuuaucuaggauguauaauggguaugcaggugguuuugaggugcaggugauccucgcggggaaugcguucaccgcggggaagaucauauucgcagcaauccccccaaauuuucccacugauggccugaguccuagucaggucaccauguuuccgcauauaauuguggauguuagacaauuggaaccugugcugauacccuuacccgauguuaggaacaauuuuuaucauuauaaucaggcaaaugauuccaccuugaaauugauagcuaugcuguacacaccacuuagagcuaauaaugcuggagaugauguuuuuacuguuucuugccguguauuaacaaggccauccccugauuuugauuucauauucuuggucccucccacagucgaaucaagaacgaaaccuuucacugucccuauacugacuguugaugaaaugaccaauucgagguucccuaccccccuggagaaauugcauacgggcccaaacaacucuauaguuguccaaccucagaauggaaggugcacaauugauggcguccucuugggcacuacgcaguuguccaccgucaacaucugcaacuuuagagguagcaccacacgugcaggucagucacacgccuacacgaugaauuuggucucucaaaauuggaacaauuaugacccaacagaggagauuccagccccuuuggggacaccagacuuugucgggaagaucgugggcaugcucucgcagaccaccagagagaacaguucaacgcgagcccacaaggccacggugagcacuggagaugcccacuucacgccaaagucaggcagugucuuguucaccacugacacugacgaccuccaaaauggccaaaauacaagauucaccccagucggaguugcacaagauggugaaccccaccagaaugagccacaacaauggcgacucccaaauuauucuggcacacccggccacaaugugcaccuggcacccccugucgcacccacuuucccaggugaacaguugcucuucuuuagguccaccaugccagguuguggugguuauccuaacauggauuuggauugccugcucccucaagagugggugcgccauuucuaccaagaagccgcaccagcacaaucugauguggcucugcugagguuugugaauccagacacgggaaggguguuauuugagugcaagcuccacaaggcaggauacaucacagucucucacacuggucccuaugacuuggucauuccaccuaaugguuacuuuagauuugauuccuggguuaaucaguuuuaugcacuugcccccaugggaacuggaacggggcgcagacgugcuuuauaa

SEQ ID NO: 4817 - RNA, 1629 nt, Artificial Sequence
  VP1,_capsid_protein__Norovirus__BAL60749
augaagauggcgucgaaugacgccgcuccaucuacugauggugcagccggccucgugccagaaaguaauaaugaggucauggcucuugaaccuguggcuggugccgcuuuggcagccccggucacuggucaaacaaauauuauagacccuuggauuagagcaaauuuuguccaggccccuaauggugaauuuacaguuucuccccguaaugccccuggugaagugcuguugagucuagaguuggguccagaauuaaauccuuaucuggcacacuuagcaagaauguacaauggauaugccggugggauggaggugcaagucauguuggcugggaacgcguucacagccggcaaguuggucuucgccgcugugccaccucauuucccgguugaaaaccuuaguccacagcaaauuaccauguucccucacgugauuauagauguaaggacuuuggaaccuguuuuauuaccacucccugaugugagaaauaauuucuuccauuauaaucagaaagaugaucccaaaaugagaauuguugcuaugcuuuauaccccccuuaggucuaaugguucaggugaugauguguuuacagucuccuguaggguguugacuagacccucuccugauuuugauuucacauaccuggugccaccaacaguggaauccaaaacaaaaccauuuacccuuccaauccucacacuuggggagcuuuccaauucuagauuuccaguguccauagaucagauguauacuagccccaaugaaguuauaucugugcagugucaaaaugguaggugcacacuggauggggagcuccaaggaacaacacaacuccaggucaguggcauuugugcuuucaagggagaaguuaccgcccauuugcaugacaaugaucaccuauauaaugucaccauuacaaacuugaauggguccccuuuugaccccucugaggacguccccgccccucugggugugccugacuuccagggaagggucuuuggugucaucucccaaagagauaaacagaaugccgcuggacauaaugaaccagcaaacaggggacacgacgcuguggucccuacuuacacagcacaguacacuccaaaacugggucaaguucaaauugguacguggcagaccgacgaucuccaagucaaucaaccaguuaaauuuaccccagucggccuuaaugacacugagcauuuuaaucaauggguggucccuagguaugcuggugcuuuaaaucuaaacacaaaucuugccccuucuguugcuccaguguuuccaggggagcgccugcucuuuuucagaucauauaucccccucaaaggugguuauggaaacccagccauugauugccuacuaccacaggagugggugcaacauuuuuaucaggaagcagccccuucaaugagugagguggcccuugucagguacaucaacccggacacuggucgggcacuguuugaggccaagcuccauagagcugguuucaugacggucucgagcaacaccagugcuccggugguugugccugccaacggauacuucagauuugacucuuggguaaaccaauucuauucucucgcccccaugggaacuggaaaugggcguagaaggguucaauaa

SEQ ID NO: 4818 - RNA, 1629 nt, Artificial Sequence
  VP1,_capsid_protein__Norovirus__BAL60753
augaagauggcgucgaaugacgccgcuccaucuacugauggugcagccggccucgugccagaaaguaauaaugaggucauggcucuugaacccguggcuggcgccgccuuggcagccccggucaccggucaaacaaauauuauagacccuuggauuagagcaaauuuuguccaggccccuaauggugaauuuacagucucuccccguaaugccccuggugaagugcuauugaaucuagaguuggguccagaauuaaauccuuaucuggcacauuuagcaagaauguacaacggguaugccggugggauggaggugcaggucauguuggcugggaacgcguucacagccggcaaguuggucuucgccgcugugccaccucacuucccgguugaaaaccuuaguccgcagcaaauuaccauguucccucaugugauuauagauguaaggacuuuggaaccuguuuuauuaccacucccugauguuagaaacaauuucuuccauuauaaucagaaagaugaucccaagaugagaauuguggcuaugcuuuauaccccccuuaggucuaaugguucaggugaugauguguuuacagucuccugcaggguguugacuagacccuccccugauuuugauuucacauaucuggugccaccaacaguggagucuaaaacaaaaccauuuacccucccaauccucacacuuggggaacuuuccaauucuagauucccaguguccauagaccagauguacaccagccccaaugaaguuauaucagugcagugucaaaaugguaggugcacacuggauggggagcuccaaggaacaacacaacuccaagucaguggcauuugugcuuucaagggagaagugaccgcccauuugcaugacaaugaucaucuauauaaugucaccaucacaaacuugaaugggucccccuuugaccccuccgaggacaucccugccccucugggcguaccugacuuucagggaaggguuuuuggugucaucucccaaagagacaaacacaauuccccuggacauaaugaaccagcaaauagggggcacgacgcuguggucccuacuuacacaucacaguacacuccaaaauugggucagauucaaauuggcacauggcaaaccgaugaucuuacagucaaccaaccagucaaauucaccccaguugggcucaaugacacugaacauuuuaaccaaugggugguccccagauaugcuggugcucuaaaccuuaacacaaaccuugccccuucuguugcuccaguauuuccaggggagcgccugcucuuuuucagaucauacaucccccucaagggugguuauggaaauccagccauugauugccuacuaccacaagagugggugcagcauuucuaucaggaagcagccccuucaaugagugagguggcccuugucagauacaucaacccggauacuggucgggcacuguucgaggccaaacuccacagagcugguuucaugacagucucaagcaacaccagugccccggugguugugccugccaacggauacuucagauuugauucuugggugaaccaauucuauucucucgcccccaugggaacuggaaaugggcguagaaggguucaauaa

SEQ ID NO: 4819 - RNA, 1629 nt, Artificial Sequence
  VP1,_capsid_protein__Norovirus__BAL60755
augaagauggcgucgaaugacgccgcuccaucuacugauggugcagccggccucgugccagaaaguaauaaugaggucauggcucuugaacccguggcuggcgccgccuuggcagccccggucaccggucaaacaaauauuauagacccuuggauuagagcaaauuuuguccaggccccuaauggugaauuuacagucucuccccguaaugccccuggugaagugcuauugaaucuagaguuggguccagaauuaaauccuuaucuggcacauuuagcaagaauguacaacggguaugccggugggauggaggugcaggucauguuggcugggaacgcguucacagccggcaaguuggucuucgccgcugugccaccucacuucccgguugaaaaccuuaguccacagcaaauuaccauguucccucaugugauuauagauguaaggacuuuggaaccuguuuuauuaccacucccugauguuagaaacaauuucuuccauuauaaucagaaagaugaucccaagaugagaauuguggcuaugcuuuauaccccccucaggucuaaugguucaggugaugauguguuuacagucuccugcaggguguugacuagacccuccccugauuuugauuucacauaucuggugccaccaacaguggagucuaaaacaaaaccauuuacccucccaauccucacacuuggggaacuuuccaauucuagauucccaguguccauagaccagauguacaccagccccaaugaaguuauaucagugcagugucaaaaugguaggugcacacuggauggggagcuccaaggaacaacacaacuccaagucaguggcauuugugcuuucaagggagaagugaccgcccauuugcaugacaaugaucaucuauauaaugucaccaucacaaacuugaaugggucccccuuugaccccuccgaggacaucccugccccucugggcguaccugacuuucagggaaggguuuuuggugucaucucccaaagagacaaacacaauuccccuggacauaaugaaccagcaaauagggggcacgacgcuguggucccuacuuacacaucacaguacacuccaaaauugggucagauucaaauuggcacauggcaaaccgaugaucuuacagucaaccaaccagucaaauucaccccaguugggcucaaugacacugaacauuuuaaccaaugggugguccccagauaugcuggugcucuaaaccuuaacacaaaccuugccccuucuguugcuccaguauuuccaggggagcgccugcucuuuuucagaucauacaucccccucaagggugguuauggaaauccagccauugauugccuacuaccacaagagugggugcagcauuucuaucaggaagcagccccuucaaugagugagguggcccuugucagauacaucaacccggauacuggucgggcacuguuugaggccaaacuccacagagcugguuucaugacagucucaagcaacaccagugccccggugguugugccugccaacggauacuucagauuugauucuugggugaaccaauucuacucucucgcccccaugggaacuggaaaugggcguagaaggguucaauaa

SEQ ID NO: 4820 - RNA, 1629 nt, Artificial Sequence
  VP1,_capsid_protein__Norovirus__BAL60759
augaagauggcgucgaaugacgccgcuccaucuacugauggugcagccggccucgugccagaaaguaauaaugaggucauggcucuugaaccuguggcuggugccgcuuuggcagccccggucacuggucaaacaaauauuauagacccuuggauuagagcaaauuuuguccaggccccuaauggugaauuuacaguuucuccccguaaugccccuggugaagugcuguugagucuagaguuggguccagaauuaaauccuuaucuggcacacuuagcaagaauguacaauggacaugccggugggauggaggugcaagucauguuggcugggaacgcguucacagccggcaaguuggucuucgccgcugugccaccucauuucccgguugaaaaccuuaguccacagcaaauuaccauguucccucacgugauuauagauguaaggacuuuggaaccuguuuuauuaccacucccugaugugagaaauaauuucuuccauuauaaucagaaagaugaucccaaaaugagaauuguugcuaugcuuuauaccccccuuaggucuaaugguucaggugaugauguguuuacagucuccuguaggguguugacuagacccucuccugauuuugauuucacauaccuggugccaccaacaguggaauccaaaacaaaaccauuuacccuuccaauccucacacuuggggagcuuuccaauucuagauuuccaguguccauagaucagauguauacuagccccaaugaaguuauaucugugcagugucaaaaugguaggugcacacuggauggggagcuccaaggaacaacacaacuccaggucaguggcauuugugcuuucaagggagaaguuaccgcccauuugcaugacaaugaucaccuauauaaugucaccauuacaaacuugaauggguccccuuuugaccccucugaggacguccccgccccucugggugugccugacuuccagggaagggucuuuggugucaucucccaaagagauaaacagaaugccgcuggacauaaugaaccagcaaacaggggacacgacgcuguggucccuacuuacacagcacaguacacuccaaaacugggucaaguucaaauugguacguggcagaccgacgaucuccaagucaaucaaccaguuaaauuuaccccagucggccuuaaugacacugagcauuuuaaucaauggguggucccuagguaugcuggugcuuuaaaucuaaacacaaaucuugccccuucuguugcuccaguguuuccaggggagcgccugcucuuuuucagaucauauaucccccucaaaggugguuauggaaacccagccauugauugccuacuaccacaggagugggugcagcauuuuuaucaggaagcagccccuucaaugagugagguggcccuugucagguacaucaacccggacacuggucgggcacuguuugaggccaagcuccauagagcugguuucaugacggucucgagcaacaccagugcuccggugguugugccugccaacggauacuucagauuugacucuuggguaaaccaauucuauucucucgcccccaugggaacuggaaaugggcguagaaggguucaauaa

SEQ ID NO: 4821 - RNA, 1629 nt, Artificial Sequence
  VP1,_capsid_protein__Norovirus__BAL60767
augaagauggcgucgaaugacgccgcuccaucuacugauggugcagccggccucgugccagaaaguaauaaugaggucauggcucuugaacccguggcuggugccgccuuggcagccccggucaccggucaaacaaauauuauagacccuuggauuagagcaaauuuuguccaggcccccaauggugaauuuacagucucuccccguaaugccccuggugaagugcuauugaaucuagaguuggguccagaauuaaauccuuaucuggcacauuuagcaagaauguacaacggguaugccggugggauggaagugcaggucauguuggcugggaacgcguucacagccggcaaguuggucuucgccgcugugccaccucacuucccgauugaaaaccuuaguccacagcaaauuaccauguuuccucaugugauuauagauguaaggacuuuggaacccguuuuauuaccacucccugauguuagaaauaauuucuuccauuauaaucagaaagaugaucccaagaugagaaucguggccaugcuuuacaccccccuuaggucuaaugguucaggugaugauguauucacagucuccugcaggguguugacuagacccuccccugauuuugauuucacauaucuggugccaccaacaguggaaucuaaaacaaaaccauucacccucccaauucucacacuuggggaacuuuccaauucuagauuuccaguguccauagaccagauguacaccagccccaaugaaguuauaucagugcagugucaaaaugguaggugcacacuggauggggagcuccaaggaacaacacaacuccaagucaguggcauuugugcuuuuaagggagaaguaaccgcccacuugcaugacaaugaucaccuauacaauaucaccaucacaaacuugaauggguccccuuuugaucccuccgaggacaucccugccccccugggcaugccugacuuucagggaagggucuuugguaucaucucccaaagagacaggcacaauuccccuggacauaaugaaccagcaaauaggggacacgacgcuguggucccaacuuacacagcacaguacaccccaaaauugggucagauucaaauuggcacauggcagaccgacgaucucacagucagccaaccaguaaaauucaccccaguuggacucaaugauacugaacauuuuaaccaaugggugguuccuagauaugcuggugcucuaaaucuuaauacaaaucuugccccuucuguugcuccaguauuuccaggggagcgccugcucuuuuucagaucauauaucccccucaagggugguuauggaaauccagccauugauugccuauuaccacaagagugggugcaacauuucuaccaggaagcagccccuucaaugagugagguggcucuugucagauacaucaacccggauacuggucgggcacuguucgaggccaagcuccacagagcugguuucaugacagucucaagcaacaccagugccccggugguugugccugccaacggauacuuuagauuugauucuugggugaaccaauucuauucucucgcccccaugggaacuggaaaugggcguagaaggguucaauaa

SEQ ID NO: 4822 - RNA, 1629 nt, Artificial Sequence
  VP1,_capsid_protein__Norovirus__BAL60769
augaagauggcgucgaaugacgccguuccaucuacugauggugcagccggccucgugccagaaaguaauaaugaggucauggcucuugaacccguggcuggugccgccuuggcagccccggucaccggucaaacaaauauuauagacccuuggauuagagcaaauuuuguccaggcccccaauggugaguuuacaguuucuccccgcaauuccccuggugaggugcuauugaaucuagaguuggguccagaauuaaauccuuaucuggcacauuuagcaagaauguacaacggguaugccggugggauggaggugcaggucauguuggcugggaacgcguucacagccggcaaauuggucuuugccgcugugccaccucacuucccgguugaaaaccuuagcccacagcaaauuaccauguucccucaugugauuauagauguuaggacuuuggaaccuguuuuauuaccacucccugauguuagaaauaauuucuuccauuacaaucagaaagaugaucccaagaugagaauuguggcuaugcuuuacaccccccuuaggucuaaugguucaggugaugauguguuuacagucucaugcaggguguugacuagacccuccccugauuuugauuucacauaccuggugccaccaacaguggaaucuaaaacaaaaccauuuacucucccaauccucacgcuuggggaacuuuccaauucuagauucccaguguccauagaccagauguacaccagccccaaugaaguuauaucaguacagugucaaaacggcaggugcacacuggauggggaacuccaaggaacaacacaacuccaagucaguggcauuugugcuuucaagggggaagugacugcccacuugcaugacaaugaacaccuguacaaugucaccaucacaaacuugaaugggucuccuuucgaccccuccgaggacauccccgccccucugggcguaccugacuuucagggaagggucuuugguguuaucucccaaagagacaaacacaauaccccuggacauaaugaaccagcaaacagggcacacgaugccgugguaccuacuuacacagcacaguacacuccaaaauugggucagguccaaauuggcacauggcaaaccgacgaucucacagacaaccaaccagucaaauucaccccaguuggacuuaaugauacugaacauuuuaaccaaugggugguccccagauaugcuggugcccuaaaccuuaacacaaaccuugccccuucuguugcuccaguauuuccaggggagcgccugcucuuuuucagaucauacaucccccucaagggugguuauggaacuccagccauugauugccuacuaccacaagagugggugcaacauuucuaucaggaagcagccccuucgaugagugagguggcccuugucagauacaucaacccagauacuggucgggcacuguuugaggccaaacuccacagagcugguuucaugacagucucaagcaacaccagugccccggugguugugccugccaacggauacuucagauuugacucuugggugaaccaauucuauucucuugcccccaugggaacuggaaaugggcguagaaggauccaauaa

SEQ ID NO: 4823 - RNA, 1629 nt, Artificial Sequence
  VP1,_capsid_protein__Norovirus__BAL60771
augaagauggcgucgaaugacgccgcuccaucuacugauggugcagccggccucgugccagaaaguaauaaugaggucauggcucuugaacccguggcuggugccgccuuggcagccccagucaccggucaaacaaauauuauagacccuuggauuagagcaaauuuuguccaggcccccaauggugaauuuacagucucuccccguaaugcaccuggugaagugcuauugaaucuagaguuggguccagaauuaaauccuuaucuggcacauuuagcaagaauguacaacggguaugccggugggauggaggugcaggucauguuggcugggaacgcguucacagccggcaaguuggucuucgccgcugugccaccucacuucccgguugaaaaccuuaguccacagcaaauuaccauguucccucaugugauuauagauguaaggaccuuggaacccguuuuauuaccacucccugauguuagaaauaauuucuuccauuauaaucagaaagaugaucccaagaugagaaucguggcuaugcuuuacaccccccuuaggucuaaugguucaggugaugauguauucacagucuccugcaggguguugacuagacccuccccugacuuugauuucacauaccuggugccaccaacaguagaaucuaaaacaaaaccauucacccucccaauucucacacuuggggaacuuuccaauucuagauucccaguguccauagaucagauguacaccaguccuaaugaagucauaucagugcagugucaaaaugguaggugcacacuggauggggagcuccaaggaacaacacaacuccaagucaguggcauuugugcuuucaagggagaaguaaccgcccacuugcaugacaacgaucaccuauacaacaucaccaucacaaacuugaauggguccccuuuugaucccuccgaggacaucccugcccccuugggcguaccugacuuucagggaagggucuuugguaucaucucccaaagagacaagcacaauuccccuggacauaaugaaccagcaaauaggggacaugacgcuguggucccuacuuacacagcacaguacacuccaaaauugggucagauucaaauuggcacauggcagaccgacgaucucacagucagccaaccagugaaauucaccccaguuggacucaaugauacugaacauuuuaaucaaugggugguuccuagauaugcuggugcuuuaaaucuuaauacaaaucuugccccuucuguugcuccaguauuuccaggggagcgccugcucuuuuucagaucauauaucccccucaagggugguuauggaaauccagccauugauugccuacuaccacaagagugggugcaacauuucuaccaggaagcagccccuucaaugagugagguggcccuugucagauacaucaacccggauacuggucgggcacuguucgaggccaagcuccacagagcugguuucaugacagucucaagcaacaccagugccccggugguugugccugccaacggguacuuuagauuugauucuugggugaaccaauucuacucucucgcccccaugggaacuggaaaugggcguagaaggguucaauaa

SEQ ID NO: 4824 - RNA, 1629 nt, Artificial Sequence
  VP1,_capsid_protein__Norovirus__BAL60773
augaagauggcgucgaaugacgccgcuccaucuacugauggugcagccggccucgugccagaaaguaauaaugaggucauggcucuugaacccguggcuggugccgcuuuggcagccccggucaccggucaaacaaauauuauagacccuuggauuagagcaaauuuuguccaggcccccaauggugaauuuacagucucuccccguaaugccccuggugaagugcuacugaaucuagaguuggguccagaauuaaauccuuaucuggcacauuuagcaagaauguacaacggguaugccggugggauggaggugcaggucauguuggcugggaacgcguucacagccggcaaguuggucuucgccgcugugccaccucacuucccgguugaaaaccuuagcccacagcaaauuaccauguucccccaugugauuauagauguaaggacuuuggaaccuguuuuguuaccacucccugauguuagaaauaacuucuuccauuauaaucagaaagaugaucccaagaugagaauuguggcuaugcuuuacacuccccuuaggucuaauggcucaggugaugauguguuuacagucuccugcaggguguugacuagacccuccccugauuuugauuucacauaccuggugccaccaacaguggaaucuaaaacaaaaccauucacccucccaauccucacacuuggggaacuuuccaauucuagauucccaguguccauagaucagauguacaccagcccuaaugaaguuauaucagugcagugucaaaaugguaggugcacauuggauggggagcuccaagggacaacacaacuccaagucaguggcauuugugcuuucaagggagaagugaccgcccacuugcaugacaaugaucaccuauauaaugucaccaucacaaacuugaauggauccccuuuugaccccuccgaggacaucccugccccucugggcguaccugacuuucagggaagggucuuuggcaucaucucccaaagagacaaacacaauagcccuggacauaaugaaccagcaaacaggggacacgaugcuguggucccuacuuacacagcacaguacacuccaaaauugggucagauucaaauuggcacauggcagaccgacgaucuuacugucaaccaaccagucaaauucaccccaguuggacuuaaugacacugaacauuuuaaccaaugggugguccccagauaugcuggugcccuaaaccuuaacacaaaccuugccccuucuguugcuccaguauucccaggggagcgccugcucuuuuucagaucauacauuccccucaaggguggcuauggaaauccagccauugauugccuacuaccacaagagugggugcaacauuucuaucaggaagcagccccuucaaugagugagguggcccuugucagauacaucaacccggauacuggucgggcacuguuugaggccaagcuccacagagcugguuucaugacagucucaagcaacaccagugccccggugguugugccugccaauggauacuucagauuugauucuugggugaaccaauuuuauucucucgcccccaugggaacuggaaaugggcguagaaggguucaauaa

SEQ ID NO: 4825 - RNA, 1629 nt, Artificial Sequence
  VP1,_capsid_protein__Norovirus__BAL60775
augaagauggcgucgaaugacgccgcuccaucuacugauggugcagccggccucgugccagaaaguaauaaugaggucauggcucuugaacccguggcuggugccgccuuggcagccccggucaccggucaaacaaauauuauagacccuuggauuagagcaaauuuuguccaggcccccaauggugaauuuacagucucuccccguaaugccccuggugaagugcuauugaaucuagaguuggguccagaauuaaauccuuaucuggcacauuuagcaagaauguacaacggguaugccggugggauggaggugcaagucauguuggcugggaacgcguucacagccggcaaguuggucuucgccgcugugccaccucacuucccgauugaaaaccuuaguccacagcaaauuacuauguuuccucaugugauuauagauguaaggacuuuggaacccguuuuauuaccacucccugauguuagaaauaauuucuuccauuauaaucagaaagaugaccccaagaugagaaucguggcuaugcucuacaccccccuuaggucuaaugguucaggugaugauguauucacagucuccugcaggguguugacuagacccuccccugauuuugauuucacauaucugguaccaccaacaguggaaucuaaaacaaaaccauucacccucccaauccucacacuuggggaacuuuccaauucuagauucccaguguccauagaccagauguacaccagccccaaugaagucauaucagugcagugucagaaugguaggugcacgcuggauggggagcuccaaggaacaacacaacuccaagucaguggcauuugugcuuuuaagggagaaguaaccgcccacuugcaugauaaugaucaccuauacaauaucaccaucacaaacuugaauggguccccuuuugaucccuccgaggacaucccugccccccugggcguaccugacuuucagggaagggucuuugguaucaucucccaaagagacaagcacaauuccccuggacauaaugaaccagcaaauaggggacacgacgcuguggucccuacuuacacagcacaguacacuccaaaauugggucagauucaaauuggcacauggcagaccgacgaucucacagucagccaaccaguaaaguucaccccaguuggacucaaugauacugaacauuuuaaccaaugggugguuccuagauaugcuggugcucuaaaucuuaauacaaaucuugccccuucuguugcuccaguauuuccaggggagcgccugcucuuuuucagaucauauaucccccucaagggugguuauggaaauccagccauugauugccuacugccacaagagugggugcaacauuucuaccaggaagcagccccuucaaugagugagguggcccuugucagauacaucaacccggauacuggucgggcacuguucgaggccaagcuccacagagcugguuucaugacagucucaagcaacaccagugccccggugguugugccugccaacggauacuuuagauuugauucuugggugaaccaauucuauucucucgcccccaugggaacuggaaaugggcguagaagaguucaauaa

SEQ ID NO: 4826 - RNA, 1629 nt, Artificial Sequence
  VP1,_capsid_protein__Norovirus__BAL60777
augaagauggcgucgaaugacgccgcuccaucuacugauggugcagccggccucgugccagaaaguaauaaugaggucauggcucuugaacccguggcuggugccgccuuggcagccccggucaccggucaaacaaauauuauagacccuuggauuagagcaaauuuuguccaggcccccaauggugaauuuacagucucuccccguaaugccccuggugaagugcuauugaaucuagaguuggguccagaauuaaauccuuaucuggcacauuuagcaagaauguacaacggguaugccggugggauggaggugcaagucauguuggcugggaacgcguucacagccggcaaguuggucuucgccgcugugccaccucacuucccgauugaaaaccuuaguccacagcaaauuaccauguuuccucaugugauuauagauguaaggacuuuggaacccguuuuauuaccacucccugauguuagaaauaauuucuuccauuauaaucagaaagaugaucccaagaugagaaucguggcuaugcucuacaccccccuuaggucuaaugguucaggugaugauguauucacagucuccugcaggguguugacuagacccuccccugauuuugauuucacauaucugguaccaccaacaguggaaucuaaaacaaaaccauucacccucccaauccucacacuuggggaacuuuccaauucuagauucccaguguccauagaccagauguacaccagccccaaugaagucauaucagugcagugucagaaugguaggugcacgcuggauggggagcuccaaggaacaacacaacuccaagucaguggcauuugugcuuuuaagggagaaguaaccgcccacuugcaugauaaugaucaccuauacaauaucaccaucacaaacuugaauggguccccuuuugaucccuccgaggacaucccugccccccugggcguaccugacuuucagggaagggucuuugguaucaucucccaaagagacaagcacaauuccccuggacauaaugaaccagcaaauaggggacacgacgcuguggucccuacuuacacagcacaguacacuccaaaauugggucagauucaaauuggcacauggcagaccgacgaucucacagucagccaaccaguaaaguucaccccaguuggacucaaugauacugaacauuuuaaccaaugggugguuccuagauaugcuggugcucuaaaucuuaauacaaaucuugccccuucuguugcuccaguauuuccaggggagcgccugcucuuuuucagaucauauaucccccucaagggugguuauggaaauccagccauugauugccuacugccacaagagugggugcaacauuucuaccaggaagcagccccuucaaugagugagguggcccuugucagauacaucaacccggauacuggucgggcacuguucgaggccaagcuccacagagcugguuucaugacagucucaagcaacaccagugccccggugguugugccugccaacggauacuuuagauuugauucuugggugaaccaauucuauucucucgcccccaugggaacuggaaaugggcguagaagaguucaauaa

SEQ ID NO: 4827 - RNA, 1629 nt, Artificial Sequence
  VP1,_capsid_protein__Norovirus__BAL60779
augaagauggcgucgaaugacgccgcuccaucuacugauggugcagccggccucgugccagaaaguaauaaugaggucauggcucuugaacccguggcuggugccgccuuggcagccccggucaccggucaaacaaauauuauagacccuuggauuagagcaaauuuuguccaggcccccaauggugaauuuacagucucuccccguaaugccccuggugaagugcuauugaaucuagaguuggguccagaauuaaauccuuaucuggcacauuuagcaagaauguacaacggguaugccggugggauggaggugcaggucauguuggcugggaacgcguucacagccggcaaguuggucuucgccgcugugccaccucauuucccgauugaaaaccuuaguccacagcaaauuaccauguuuccucaugugauuauagauguaaggacuuuggaacccguuuuauuaccacucccugauguuagaaauaauuucuuccauuauaaucagaaagaugaucccaagaugagaaucguggcuaugcuuuacaccccccuuaggucuaaugguucaggugaugauguauucacagucuccugcaggguguugacuagacccuccccugauuuugauuucacauaucuggugccaccaacaguggaaucuaaaacaaaaccauucacccucccaauucucacacuuggggaacuuuccaauucuagauucccaguguccauagaccagauguacaccagccccaaugaagucauaucagugcagugucaaaaugguaggugcacacuggauggggagcuccaaggaacaacacaacuccaagucaguggcauuugugcuuuuaagggagaaguaaccgcccacuugcaugacaaugaucaccuauacaauaucaccaucacaaacuugaauggguccccuuuugaucccuccgaggacaucccugccccccugggcguaccugacuuucagggaagggucuuugguaucaucucccaaagagacaagcacaauuccccuggacauaaugaaccagcaaauaggggacacgacgcuguggucccuacuuacacagcacaguacacuccaaaauugggucagauucaaauuggcacauggcagaccgacgaucucacagucagccaaccaguaaaauucaccccaguuggacucaaugauacugaacauuuuaaccaauggguaguuccuagauaugcuggugcucuaaaucuuaauacaaaucuugccccuucuguugcuccaguauuuccaggggagcgccugcucuuuuucagaucauauaucccccucaagggugguuauggaaauccagccauugauugccugcuaccacaagagugggugcaacauuucuaccaggaagcagccccuucaaugagugagguggcccuugucagauacaucaacccggauacuggucgggcacuguucgaggccaagcuccacagagcugguuucaugacagucucaagcaacaccagugccccggugguugugccugccaacggauacuuuagauuugauucuugggugaaccaauucuauucucucgcccccaugggaacuggaaaugggcguagaaggguucaauaa

SEQ ID NO: 4828 - RNA, 1629 nt, Artificial Sequence
  VP1,_capsid_protein__Norovirus__BAL60781
augaagauggcgucgaaugacgccgcuccaucuacugauggugcagccggccucgugccagaaaguaauaaugaggucauggcucuugaacccguggcuggugccgcuuuggcagccccggucaccggucaaacaaauauuauagacccuuggauuagagcaaauuuuguccaggcccccaauggugaauuuacagucucuccccguaaugccccuggugaagugcuauugaaucuagaguuggguccagaauuaaauccuuaucuggcacauuuagcaagaauguacaacggguaugccggugggauggaggugcaggucauguuagcugggaacgcguucacagccggcaaguuggucuucgccgcugugccaccucacuucccgguugaaaaccuuagcccacagcaaauuaccauguucccucaugugauuauagauguaagaacuuuggaaccuguuuuauuaccacucccugauguuagaaauaauuucuuccacuauaaucagaaagaugaucccaagaugagaauuguggcuaugcuuuacaccccccuuaggucuaauggcucaggugaugauguguuuacaguuuccugcaggguguugacuagacccuccccugauuuugauuucacauaucuggugccaccaacaguggaaucuaaaacaaaaccauucacccucccaauccuuacacuuggggaacuuuccaauucuagauucccaguguccauagaccaaauguacaccagcccuaaugaaguuauaucagugcagugucaaaaugguaggugcacauuggacggggagcuccaagggacaacacaacuccaagucaguggcaucugugccuucaagggagaagugaccgcccauuugcaugauaaugaucacuuauauaaugucaccaucacaaacuugaauggauccccuuuugaccccuccgaggacaucccugccccucugggcguaccugauuuucagggaagggucuuugguaucgucucccaaagagacaaacacaacagcccuggacauaaugaaccagcaaacaggggacacgaugcuguggucccuacuuacacagcacaguacacuccaaaauugggucagauucaaauuggcacauggcagaccgacgaucuuacagucaaccaaccagucaaauucaccccaguuggacucaaugauauugaacauuuuaaccaaugggugguccccagauaugcuggugcucuaaaccucaacacaaaccuugccccuucuguugcuccaguauuuccaggggagcgccugcucuuuuucagaucauacauuccccucaagggugguuauggaaauccagccauugauugccuacuaccacaagaaugggugcaacauuucuaccaggaagcagcccccucaaugagugagguggcccuugucagauacaucaacccggacacuggucgggcacuguuugaggccaagcuccacagagcugguuucaugacagucucaagcaacaccagugccccggugguugugccugccaauggauacuucagauuugauucuugggugaaccaauucuauucucucgcccccaugggaacuggaaaugggcguagaaggguucaauaa

SEQ ID NO: 4829 - RNA, 1629 nt, Artificial Sequence
  VP1,_capsid_protein__Norovirus__BAL60783
augaagauggcgucgaaugacgccgcuccaucuacugauggugcagccggccucgugccagaaaguaauaaugaggucauggcucuugaacccguggcuggugcugccuuggcagccccggucaccggucaaacaaauauuauagacccuuggauuagagcaaauuuuguccaggcccccaauggugaguuuacaguuucuccccgcaauuccccuggugaggugcuauugaaucuagaguuggguccagaauuaaauccuuaucuggcacauuuagcaagaauguacaacggguaugccggugggauggaggugcaggucauguuggcugggaacgcguucacagccggcaaguuggucuucgccgcuguaccaccucacuucccgguugaaaaccuuagcccacagcaaauuaccauguucccucaugugauuauagauguuaggacuuuggaaccuguuuuguuaccacucccugauguuagaaauaauuucuuccauuacaaucagaaagaugaucccaagaugagaauuguggcuaugcuuuacaccccccuuaggucuaaugguucaggugacgauguguuuacagucuccugcaggguguugacuagacccuccccugauuuugauuucacauaucuggugccaccaacaguggaaucuaaaacaaaaccauucacucucccaauccucacgcuuggggaacuuuccaauucuagauucccaguguccauagaccagauguacaccagccccaaugaaguuauaucagugcagugucaaaauggcaggugcacacuggauggggaacuccaaggaacaacacaacuccaagucaguggcauuugugcuuucaagggagaagugaccgcccacuugcaugacaaugaacaccuguauaaugucaccaucauaaacuugaauggguccccuuuugaccccuccgaggacauccccgccccucugggcguaccugacuuucagggaagggucuuuggugucaucucccaaagagacaaacacaauaccccuggacauaaugaaccagcaaacagggcacacgaugccguggucccuacuuacacagcacaguacacuccaaaauugggucagauucaaauuggcacauggcagaccgacgaucucacaaacaaccaaccagucaaauucaccccaguuggacuuaaugauacugaacauuuugaccaaugggugguccccagauaugcuggugcccuaaaccuuaacacaaaccuugccccuucuguugcuccaguauuuccaggggagcgccugcucuuuuucagaucauacaucccccucaagggugguuauggaacuccagccauugauugccuacuaccacaagagugggugcaacauuucuaucaggaagcagccccuucgaugagugagguggcccuugucagauacaucaacccggauacuggucgggcacuguuugaggccaaacuccacagagcugguuucaugacagucucaagcaacaccagugccccggugguugugccugccaacggauacuucagauuugacucuugggugaaccaauucuauucucucgcccccaugggaacuggaaaugggcguagaaggauccaauaa

SEQ ID NO: 4830 - RNA, 1629 nt, Artificial Sequence
  VP1,_capsid_protein__Norovirus__BAL60785
augaagauggcgucgaaugacgccgcuccaucuacugauggugcagccggccucgugccagaaaguaauaaugaggucauggcucuugaacccguggcuggugccgccuuggcagccccggucaccggucaaacaaauauuauagacccuuggauuagagcaaauuuuguccaggccccuaauggugaauuuacagucucuccccguaaugccccuggugaagugcuauugaaucuagaguuggguccagaauuaaauccuuaucuggcacauuuagcaagaauguacaacggguaugccggugggauggaggugcaggucauguuggcugggaacgcguucacagccggcaaguuggucuucgccgcugugccaccucacuucccgauugaaaaccuuaguccacagcaaauuaccauguuuccucaugugauuauagauguaaggacuuuggaacccguuuuauuaccacucccugauguuagaaauaauuucuuccauuauaaucagaaagaugaucccaagaugagaaucguggcuaugcuuuacaccccccuuaggucuaaugguucaggugaugauguauucacagucuccugcaggguguugacuagacccuccccugauuuugauuucacauaucuggugccaccaacaguggaaucuaaaacaaaaccauucacccucccaauucucacacuuggggaacuuuccaauucuagauucccaguguccauagaucagauguacaccagccccaaugaagucauaucagugcagugucaaaaugguaggugcacacuggauggggagcuccaaggaacaacacaacuccaagucagugguauuugugcuuuuaagggagaaguaaccgcccacuugcaugacaaugaucaccuauacaaugucaccaucacaaacuugaauggguccccuuuugaccccuccgaggacaucccugccccccugggcguaccugacuuucagggaagggucuuugguaucaucucccaaagagacaagcacaauuccccuggacaaaaugaaccagcaaauaggggacacgacgcuguggucccuacuuacacagcacaguacacuccaaaauugggucagauucaaauuggcacauggcagaccgacgaucucacagucagccaaccaguaaaguucaccccaguuggacucaaugauacugaacauuuuaaccaaugggugguuccuagauaugcuggugcucuaaaucuuaauacaaaucuugccccuucuguugcuccaguauuuccaggggagcgccugcucuuuuucagaucauauaucccccucaagggugguuauggaaauccagccauugauugucuacuaccacaagagugggugcaacauuucuaccaggaagcagccccuucaaugagugagguggcccuugucagauacaucaacccggauacuggucgggcacuguuugaggccaagcuccacagagcugguuucaugacagucucaagcaacaccagugccccggugguugugccugccaacggauacuuuagauuugauucuugggugaaccaauucuauucucucgcccccaugggaacuggaaaugggcguagaaggguucaauaa

SEQ ID NO: 4831 - RNA, 1629 nt, Artificial Sequence
  VP1,_capsid_protein__Norovirus__BAL60791
augaagauggcgucgaaugacgccgcuccaucuacugauggugcagccggccucgugccagaaaguaauaaugaggucauggcucuugaacccguggcuggugccgccuuggcagccccggucaccggucaaacaaauauuauagacccuuggauuagagcaaauuuuguccaggcccccaauggugaauuuacagucucuccccguaaugccccuggugaagugcuauugaaucuagaguuggguccagaauuaaauccuuaucuggcacauuuagcaagaauguacaacggguaugccggugggauggaggugcaggucauguuggcugggaacgcguucacagccggcaaguuggucuucgccgcugugccaccucacuucccgauugaaaaccuuagcccacagcaaauuaccauguuuccucaugugauuauagauguaaggacuuuggaacccguuuuauuaccacucccugauguuagaaauaauuucuuccacuauaaucagaaagaugaucccaagaugagaaucguggcuaugcuuuacaccccccuuaggucuaaugguucaggugaugacguauucacagucuccugcaggguguugacuagacccuccccugauuuugauuucacauaccuggugccaccaacaguggagucuaaaacaaaaccauucacccucccaauucucacacuuggggaacuuuccaauucuagauucccaguguccauagaccagauguacaccagccccaaugaagucauaucagugcagugucaaaaugguaggugcacacuggauggggagcuccaaggaacgacccaacuccaggucaguggcauuugugcuuuuaagggagaaguaacugcccacuugcaugacaaugaucaccuauacaacaucaccaucacaaacuugaauggguccccuuuugaucccuccgaggacaucccugccccccugggcguaccugacuuucagggaagagucuuugguaucaucucccaaagagacaagcacaauuccccuggacauaaugaaccagcaaauagaggacacgacgcuguggucccuaccuacacagcacaguacacuccaaaauugggucagauucaaauuggcacauggcagaccgacgaucucacagucagccaaccaguaaaauucaccccaguuggacucaaugauacugaacauuuuaaccaaugggugguuccuagauaugcuggugcucuaaaucuuaauacaaaucuugccccuucuguugcuccaguauuuccaggggagcgccuacucuuuuucagaucauauaucccccucaagggugguuauggaaauccagccauugauugccuacuaccacaagagugggugcaacauuucuaccaggaagcagccccuucaaugagugagguggcccuugucagauacaucaacccggauacuggucgggcacuguucgaggccaagcuccacagagcugguuucaugacaguuucaagcaacaccagugccccggugguugugccugccaacggauacuuuagauuugauucuugggugaaccaauucuauucucucgcccccaugggaacugggaaugggcguagaaggguucaauaa

SEQ ID NO: 4832 - RNA, 1629 nt, Artificial Sequence
  VP1,_capsid_protein__Norovirus__BAL60793
augaagauggcgucgaaugacgccgcuccaucuacugauggugcagccggccucgugccagaaaguaauaaugaggucauggcucuugaacccguggcuggugccgccuuggcagccccggucaccggucaaacaaauauuauagacccuuggauuagagcaaauuuuguccaggcccccaauggugaauuuacagucucuccccguaaugccccuggugaagugcuauugaaucuagaguuggguccagaauuaaauccuuaucuggcacauuuagcaagaauguacaacggguaugccggugggauggaggugcaggucauguuggcugggaacgcguucacagccggcaaguuggucuucgccgcugugccaccucacuucccgauugaaaaccuuagcccacagcaaauuacuauguuuccucaugugauuauagauguaaggacuuuggaacccguuuuauuaccacucccugauguuagaaauaauuucuuccacuauaaucagaaagaugaucccaagaugagaaucguggcuaugcuuuacaccccccuuaggucuaaugguucaggugaugacguauucacagucuccugcaggguguugacuagacccuccccugauuuugauuucacauaccuggugccaccaacaguggagucuaaaacaaaaccauucacccucccaauucucacacuuggggaacuuuccaauucuagauucccaguguccauagaccagauguacaccagccccaaugaagucauaucagugcagugucaaaaugguaggugcacacuggauggggagcuccaaggaacgacccaacuccaggucaguggcauuugugcuuuuaagggagaaguaacugcccacuugcaugacaaugaucaccuauacaacaucaccaucacaaacuugaauggguccccuuuugaucccuccgaggacaucccugccccccugggcguaccugacuuucagggaagagucuuugguaucaucucccaaagagacaagcacaauuccccuggacauaaugaaccagcaaauagaggacacgacgcuguggucccuaccuacacagcacaguacacuccaaaauugggucagauucaaauuggcacauggcagaccgacgaucucacagucagccaaccaguaaaauucaccccaguuggacucaaugauacugaacauuuuaaccaaugggugguuccuagauaugcuggugcucuaaaucuuaauacaaaucuugccccuucuguugcuccaguauuuccaggggagcgccuacucuuuuucagaucauauaucccccucaagggugguuauggaaauccagccauugauugccuacuaccacaagagugggugcaacauuucuaccaggaagcagccccuucaaugagugagguggcccuugucagauacaucaacccggauacuggucgggcacuguucgaggccaagcuccacagagcugguuucaugacaguuucaagcaacaccagugccccggugguugugccugccaacggauacuuuagauuugauucuugggugaaccaauucuauucucucgcccccaugggaacugggaaugggcguagaaggguucaauaa

SEQ ID NO: 4833 - RNA, 1629 nt, Artificial Sequence; identical to SEQ ID NO: 4831
  VP1,_capsid_protein__Norovirus__BAL60795

SEQ ID NO: 4834 - RNA, 1629 nt, Artificial Sequence
  VP1,_capsid_protein__Norovirus__BAL60797
augaagauggcgucgaaugacgccgcuccaucuacugauggugcagccggccucgugccagaaaguaauaaugaggucauggcucuugaacccguggcuggugccgccuuggcagccccggucaccggucaaacaaacauuauagacccuuggauuagagcaaauuuuguccaggcccccaauggugaauuuacagucucuccccguaaugccccuggugaagugcuauugaaucuagaguuggguccagaauuaaauccuuaucuggcacauuuagcaagaauguacaacggguaugccggugggauggaggugcaggucauguuggcugggaacgcguucacagccggcaaguuggucuucgccgcugugccaccucacuucccgauugaaaaccuuagcccacagcaaauuaccauguuuccucaugugauuauagauguaaggacuuuggaacccguuuuauuaccacucccugauguuagaaauaauuucuuccacuauaaucagaaagaugaucccaagaugagaaucguggcuaugcuuuacaccccccuuaggucuaaugguucaggugaugacguauucacagucuccugcaggguguugacuagacccuccccugauuuugauuucacauaccuggugccaccaacaguggagucuaaaacaaaaccauucacccucccaauucucacacuuggggaacuuuccaauucuagauucccaguguccauagaccagauguacaccagccccaaugaagucauaucagugcagugucaaaaugguaggugcacacuggauggggagcuccaaggaacgacccaacuccaggucaguggcauuugugcuuuuaagggagaaguaacugcccacuugcaugacaaugaucaccuauacaacaucaccaucacaaacuugaauggguccccuuuugaucccuccgaggacaucccugccccccugggcguaccugacuuucagggaagagucuuugguaucaucucccaaagagacaagcacaauuccccuggacauaaugaaccagcaaauaggggacacgacgcuguggucccuaccuacacagcacaguacacuccaaaauugggucagauucaaauuggcacauggcagaccgacgaucucacagucagccaaccaguaaaauucaccccaguuggacucaaugauacugaacauuuuaaccaaugggugguuccuagauaugcuggugcucuaaaucuuaauacaaaucuugccccuucuguugcuccaguauuuccaggggagcgccuacucuuuuucagaucauauaucccccucaagggugguuauggaaauccagccauugauugccuacuaccacaagagugggugcaacauuucuaccaggaagcagccccuucaaugagugagguggcccuugucagauacaucaacccggauacuggucgggcacuguucgaggccaagcuccacagagcugguuucaugacaguuucaagcaacaccagugccccggugguugugccugccaacggauacuuuagauuugauucuugggugaaccaauucuauucucucgcccccaugggaacugggaaugggcguagaaggguucaauaa

SEQ ID NO: 4835 - RNA, 1629 nt, Artificial Sequence
  VP1,_capsid_protein__Norovirus__BAL60799
augaagauggcgucgaaugacgccgcuccaucuacugauggugcagccggccucgugccagagaguaauaaugaggucauggcucuugaacccguggcuggugccgccuuggcagccccagucaccggucaaacaaauauuauagacccuuggauuagagcaaauuuuguccaggcccccaauggugaauuuacagucucuccccguaacuccccuggugaagugcuauugaaucuagaguuggguccagaacuaaauccuuaucuggcacauuuagcaagaauguacaauggguaugccggugggauggaggugcaggucauguuggcugggaacgcguucacagccggcaaguuagucuucgccgcugugccaccucacuucccggucgaaaaccuuagcccacagcaaauuaccauguucccucaugugauuauagaugucaggacuuuggaaccuguuuuacuaccacucccugauguuaggaauaacuucuuccauuacaaucagaaagaugaucccaagaugagaauuguggcuaugcuuuauaccccccuuaggucuaaugguucaggugaugauguguuuacagucuccugcaggguguugacuagacccuccccugauuuugauuucacauaucuggugccuccaacaguggaaucuaaaacaaaaccauucacucucccaauccucacucuuggggaacuuuccaauuccagauucccaguguccauagaccagauguacaccagccccaaugaagucauaucagugcagugucaaaauggcaggugcacacuggauggggaacuucaaggaacaacacaacuccaggucaguggcauuugugcuuucaagggagaagugacugcccacuugcaugauaaugaucaccuguauaaugucaccaucacaaacuuaaauggguccccuuuugaccccuccgaggacauucccgccccucugggcguaccugacuuucagggaagggucuuuggugucaucucccaaagagacaaacacaauaccccuggacauaaugaaccagcaaacagggcacacgaugccguggucccuacuuacacagcacaguacaccccaaaauugggucagauucaaauuggcacauggcagacugacgaucucacagucaaccaaccagucaauuucaccccagcuggacuuagugauacugaccauuuuaaccaaugggugguccccagguaugcuggugcccuaaaccuuaacacaaaccuugccccuucuguugcuccaguauuuccaggggagcgccugcucuuuuucagaucauacaucccccucaagggugguuauggaacuccagccauugauugccuacugccacaagagugggugcaacauuucuaucaggaagcagccccuucgaugagugagguggcccuugucagauacaucaacccggauacuggucgggcacuguuugaggccaaacuccacagagcugguuucaugacagucucaagcaacaccagugccccggugguugugccugccaacggauacuucagauuugauucuugggugaaccaauucuauucucucgcccccaugggaacuggaaaugggcguagaaggauccaauaa

SEQ ID NO: 4836 - RNA, 1629 nt, Artificial Sequence; identical to SEQ ID NO: 4831
  VP1,_capsid_protein__Norovirus__BAL60801

SEQ ID NO: 4837 - RNA, 1629 nt, Artificial Sequence; identical to SEQ ID NO: 4831
  VP1,_capsid_protein__Norovirus__BAL60803

SEQ ID NO: 4838 - RNA, 1629 nt, Artificial Sequence
  VP1,_capsid_protein__Norovirus__BAL60805
augaagauggcgucgaaugacgccgcuccaucuacugauggugcagccggccucgugccagaaaguaauaaugaggucauggcucuugaacccguggcuggugccgccuuggcagccccggucaccggucaaacaaauauuauagacccuuggauuagagcaaauuuuguccaggcccccaauggugaauuuacagucucuccccguaaugccccuggugaagugcuauugaaucuagaguuggguccagaauuaaauccuuaucuggcacauuuagcaagaauguacaacgggcaugccggugggauggaggugcaggucauguuggcugggaacgcguucacagccggcaaguuggucuucgccgcugugccaccucacuucccgauugaaaaccuuagcccacagcaaauuaccauguuuccucaugugauuauagauguaaggacuuuggaacccguuuuauuaccacucccugauguuagaaacaauuucuuccacuauaaucagaaagaugaucccaagaugagaaucguggcuaugcuuuacaccccccuuaggucuaaugguucaggugaugacguauucacagucuccugcaggguguugacuagacccuccccugauuuugauuucacauaccuggugccaccaacaguggagucuaaaacaaaaccauucacccucccaauucucacacuuggggaacuuuccaauucuagauucccaguguccauagaccagauguacaccagccccaaugaagucauaucagugcagugucaaaaugguaggugcacacuggauggggagcuccaaggaacgacccaacuccaggucaguggcauuugugcuuuuaagggagaaguaacugcccacuugcaugacaaugaucacuuauacaacaucaccaucacaaacuugaauggguccccuuuugaucccuccgaggacaucccugccccccugggcguaccugacuuucagggaagagucuuugguaucaucucccaaagagacaagcacaauuccccuggacauaaugaaccagcaaauagaggacacgacgcuguggucccuaccuacacagcacaguacacuccaaaauugggucagauucaaauuggcacauggcagaccgacgaucucacagucagccaaccaguaaaauucaccccaguuggacucaaugauacugaacauuuuaaccaaugggugguuccuagauaugcuggugcucuaaaucuuaauacaaaucuugccccuucuguugcuccaguauuuccaggggagcgccuacucuuuuucagaucauauaucccccucaagggugguuauggaaauccagccauugauugccuacuaccacaagagugggugcaacauuucuaccaggaagcagccccuucaaugagugagguggcccuugucagauacaucaacccggauacuggucgggcacuguucgaggccaagcuccacagagcugguuucaugacaguuucaagcaacaccagugccccggugguugugccugccaacggauacuuuagauuugauucuugggugaaccaauucuauucucucgcccccaugggaacugggaaugggcguagaaggguucaauaa

SEQ ID NO: 4839 - RNA, 1629 nt, Artificial Sequence
  VP1,_capsid_protein__Norovirus__BAL60809
augaagauggcgucgaaugacgccgcuccaucuacugauggugcagccggccucgugccagagaguaauaaugaggucauggcucuugaacccguggcuggugccgccuuggcagccccagucaccggucaaacaaauauuauagacccuuggauuagagcaaauuuuguccaggcccccaauggugaauuuacagucucuccccguaacuccccuggugaagugcuauugaaucuagaguuggguccagaauuaaauccuuaucuggcacauuuagcaagaauguacaauggguaugccggugggauggaggugcaggucauguuggcugggaacgcguucacagccggcaaguuagucuucgccgcugugccaccucacuucccggucgaaaaccuuagcccacagcaaauuaccauguucccucaugugauuauagaugucaggacuuuggaaccuguuuuacuaccacucccugauguuaggaauaacuucuuccauuacaaucagaaagaugaucccaagaugagaauuguggcuaugcuuuauaccccccuuaggucuaaugguucaggugaugauguguuuacagucuccugcaggguguugacuagacccuccccugauuuugauuucacauaucuggugccuccaacaguggaaucuaaaacaaaaccauucacucucccaauccucacucuuggggaacuuuccaauuccagauucccaguguccauagaccagauguacaccagccccaaugaagucauaucagugcagugucaaaauggcaggugcacacuggauggggaacuucaaggaacaacacaacuccaggucaguggcauuugugcuuucaagggagaagugacugcccacuugcaugauaaugaucaccuguauaaugucaccaucacaaacuuaaauggguccccuuuugaccccuccgaggacauccccgccccucugggcguaccugacuuucagggaagggucuuuggugucaucucccaaagagacaaacacaauaccccuggacauaaugaaccagcaaacagggcacacgaugccguggucccuacuuacacagcacaguacaccccaaaauugggucagauucaaauuggcacauggcagacugacgaucucacagucaaccaaccagucaauuucaccccaguuggacuuagugauacugaccauuuuaaccaaugggugguccccagguaugcuggugcccuaaaccuuaacacaaaccuugccccuucuguugcuccaguauuuccaggggagcgccugcucuuuuucagaucauacaucccccucaagggugguuauggaacuccagccauugauugccuacugccacaagagugggugcaacauuucuaucaggaagcagccccuucgaugagugagguggcccuugucagauacaucaacccggauacuggucgggcacuguuugaggccaaacuccacagagcugguuucaugacagucucaagcaacaccagugccccggugguugugccugccaacggauacuucagauuugauucuugggugaaccaauucuauucucucgcccccaugggaacuggaaaugggcguagaaggauccaauaa

SEQ ID NO: 4840 - RNA, 1629 nt, Artificial Sequence
  VP1,_capsid_protein__Norovirus__BAL60811
augaagauggcgucgaaugacgccgcuccaucuacugauggugcagccggccucgugccagaaaguaauaaugaggucauggcucuugaacccguggcuggugccgccuuggcagccccagucaccggucaaacaaauauuauagacccuuggauuagagcaaauuuuguccaggcccccaauggugaauuuacagucucuccccguaaugcaccuggugaagugcuauugaaucuagaguuggguccagaauuaaauccuuaucuggcacauuuagcaagaauguacaacggguaugccggugggauggaggugcaggucauguuggcugggaacgcguucacagccggcaaguuggucuucgccgcugugccaccucacuucccgguugaaaaccuuaguccacagcaaauuaccauguucccucaugugauuauagauguaaggaccuuggaacccguuuuauuaccacucccugauguuagaaauaauuucuuccauuauaaucagaaagaugaucccaagaugagaaucguggcuaugcuuuacaccccccuuaggucuaaugguucaggugaugauguauucacagucuccugcaggguguugacuagacccuccccugacuuugauuucacauaccuggugccaccaacaguagaaucuaaaacaaaaccauucacccucccaauucucacacuuggggaacuuuccaauucuagauucccaguguccauagaucagauguacaccaguccuaaugaagucauaucagugcagugucaaaaugguaggugcacacuggauggggagcuccaaggaacaacacaacuccaagucaguggcauuugugcuuucaagggagaaguaaccgcccacuugcaugacaacgaucaccuauacaacaucaccaucacaaacuugaauggguccccuuuugaucccuccgaggacaucccugcccccuugggcguaccugacuuucagggaagagucuuugguaucaucucccaaagagacaagcacaauuccccuggacauaaugaaccagcaaauaggggacaugacgcuguggucccuacuuacacagcacaguacacuccaaaauugggucagauucaaauuggcacauggcagaccgacgaucucacagucagccaaccagugaaauucaccccaguuggacucaaugauacugaacauuuuaaucaaugggugguucccagauaugcuggugcuuuaaaucuuaauacaaaucuugccccuucuguugcuccaguauuuccaggggagcgccugcucuucuucagaucauauauuccccucaagggugguuauggagauccagccauugauugccuacuaccacaagagugggugcaacauuucuaccaggaagcagccccuucaaugagugagguggcccuugucagauacaucaacccggauacuggucgggcacuguucgaggccaagcuccacagagcugguuucaugacagucucaagcaacaccagugcccccgugguugugccugccaacggguacuuuagauuugauucuugggugaaccaauucuacucucucgcccccaugggaacuggaaaugggcguagaaggguucaauaa

SEQ ID NO: 4841 - RNA, 1629 nt, Artificial Sequence
  VP1,_capsid_protein__Norovirus__BAL60813
augaagauggcgucgaaugacgccgcuccaucuacugauggugcagccggccucgugccagaaaguaauaaugaggucauggcucuugaacccguggcuggugccgccuuggcagccccagucaccggucaaacaaauauuauagacccuuggauuagagcaaauuuuguccaggcccccaauggugaauuuacagucucuccccguaaugcaccuggugaagugcuauugaaucuagaguuggguccugaauuaaauccuuaucuggcacauuuagcaagaauguacaacggguaugccggugggauggaggugcaggucauguuggcugggaacgcguucacagccggcaaguuggucuucgccgcugugccaccucacuucccgguugaaaaccuuaguccacagcaaauuaccauguucccucaugugauuauagauguaaggaccuuggaacccguuuuauuaccacucccugauguuagaaauaauuucuuccauuauaaucagaaagaugaucccaagaugagaaucguggcuaugcuuuacaccccccuuaggucuaaugguucaggugaugauguguucacagucuccugcaggguguugaccagacccuccccugacuuugauuucacauaccuggugccaccaacaguagaaucuaaaacaaaaccauucacccucccaauucucacacuuggggaacuuuccaauucuagauucccaguguccauagaucagauguacaccaguccuaaugaagucauaucagugcagugucaaaaugguaggugcacacuggauggggagcuccaaggaacaacacaacuccaagucaguggcauuugugcuuucaagggagaaguaaccgcccacuugcaugacaacgaucaccuauacaacaucaccaucacaaacuugaauggguccccuuuugaucccuccgaggacaucccugcccccuugggcguaccugacuuucagggaagggucuuugguaucaucucccaaagagacaagcacaauuccccuggacauaaugaaccagcaaauaggggacaugacgcuguggucccuacuuacacagcacaguacacuccaaaauugggucagauucaaauuggcacauggcagaccgacgaucucacagucagccaaccagugaaauucaccccaguuggacucaaugauacugaacauuuuaaucaaugggugguuccuagauaugcuggugcuuuaaaucuuaauacaaaucuugccccuucuguugcuccaguauuuccaggggagcgccugcucuucuucagaucauauauuccccucaagggugguuauggagauccagccauugauugccuacuaccacaagagugggugcaacauuucuaccaggaagcagccccuucaaugagugagguggcccuugucagauacaucaacccggauacuggucgggcacuguucgaggccaagcuccacagagcugguuucaugacagucucaagcaacaccagugccccggugguugugccugccaacggguauuuuagauuugauucuugggugaaccaauucuacucucucgcccccaugggaacuggaaaugggcguagaaggguucaauaa

SEQ ID NO: 4842 - RNA, 1629 nt, Artificial Sequence
  VP1,_capsid_protein__Norovirus__BAL60815
augaagauggcgucgaaugacgccgcuccaucuacugauggugcagccggccucgugccagagaguaauaaugaggucauggcucuugaacccguggcuggugccgccuuggcagccccagucaccggucaaacaaauauuauagacccuuggauuagagcaaauuuuguccaggcccccaauggugaauuuacagucucuccccguaacuccccuggugaagugcuauugaaucuagaguuggguccagaauuaaauccuuaucuggcacauuuagcaagaauguacaauggguaugccggugggauggaggugcaggucauguuggcugggaacgcguucacagccggcaaguuagucuucgccgcugugccaccucacuucccggucgaaaaccuuagcccacagcaaauuaccauguucccucaugugauuauagaugucaggacuuuggaaccuguuuuacuaccacucccugauguuaggaauaacuucuuccauuacaaucagaaagaugaucccaagaugagaauuguggcuaugcuuuacaccccccuuaggucuaaugguucaggugaugauguguuuacagucuccugcaggguguugacuagacccuccccugauuuugauuucacauaucuggugccuccaacaguggaaucuaaaacaaaaccauucacucucccaauccucacucuuggggaacuuuccaauuccagauucccaguguccauagaccagauguacaccagccccaaugaagucauaucagugcagugucaaaauggcaggugcacacuggauggggaacuucaaggaacaacacaacuccaggucaguggcauuugugcuuucaagggagaagugacugcccacuugcaugauaaugaucaccuguauaaugucaccaucacaaacuuaaauggguccccuuuugaccccuccgaggacauccccgccccucugggcguaccugacuuucagggaagggucuuuggugucaucucccaaagagacaaacacaauaccccuggacauaaugaaccagcaaacagggcacacgaugccguggucccuacuuacacagcacaguacaccccaaaauugggucagauucaaauuggcacauggcagacugacgaucucacagucaaccaaccagucaauuucaccccaguuggacuuagugauacugaccauuuuaaccaaugggugguccccagguaugcuggugcccuaaaccuuaacacaaaccuugccccuucuguugcuccaguauuuccaggggagcgccugcucuuuuucagaucauacaucccccucaagggugguuauggaacuccagccauugauugccuacugccacaagagugggugcaacauuucuaucaggaagcagccccuucgaugagugagguggcccuugucagauacaucaacccggauacuggucgggcacuguuugaggccaaacuccacagagcugguuucaugacagucucaagcaacaccagugccccggugguugugccugccaacggauacuucagauuugauucuugggugaaccaauucuauucucucgcccccaugggaacuggaaaugggcguagaaggauccaauaa

SEQ ID NO: 4843 - RNA, 1629 nt, Artificial Sequence
  VP1,_capsid_protein__Norovirus__BAL60817
augaagauggcgucgaaugacgccgcuccaucuacugauggugcagccggccucgugccagaaaguaauaaugaggucauggcucuugaacccguggcuggugccgccuuggcagccccggucaccggucaaacaaauauuauagacccuuggauuagagcaaauuuuguccaggcccccaauggugaauuuacagucucuccccguaaugccccuggugaagugcuauugaaucuagaguuggguccagaauuaaauccuuaucuggcacauuuagcaagaauguacaacggguaugccggugggauggaggugcaggucauguuggcugggaacgcguucacagccggcaaguuggucuucgccgcugugccaccucacuucccgauugaaaaccuuaguccacagcaaauuaccauguuuccucaugugauuauagauguaaggacuuuggaacccguuuuauuaccacucccugauguuagaaauaacuucuuucauuauaaucagaaagaugaucccaagaugagaaucguggcuaugcuuuacaccccccuuaggucuaaugguucaggugaugauguauucacagucuccugcaggguguugacuagacccuccccugauuuugauuucacauaccuggugccaccaacaguggaaucuaaaacaaaaccauucacccucccaauucucacacuuggggaacuuuccaauucuagauucccaguguccauagaccagauguacaccagccccaaugaagucauaucagugcagugucagaaugguaggugcacacuggauggggagcuccaaggaacaacacaacuccaagucaguggcauuugugcuuuuaagggagaaguaaccgcccacuugcaugauaaugaucaccuauacaauaucaccaucacaaacuugaauggguccccuuuugaucccuccgaggacaucccugccccccugggcgugccugacuuucagggaagggucuuugguaucaucucccaaagagacaagcacaauuccccuggacacaaugaaccagcaaauaggggacacgacgcuguggucccuacuuacacagcacaguacacuccaaaauugggucagauccaaauuggcacauggcagaccgacgaucucacagucagccaaccaguaaaguucgccccaguuggacucaaugauacugaacauuuuaaccaaugggugguuccuagauaugcuggugcucuaaaucuuaauauaaaucuugccccuucuguugcuccaguauuuccaggggagcgccugcucuuuuucagaucauauaucccccucaagggugguuauggaaauccagccauugauugccuacuaccacaagagugggugcaacauuucuaccaggaagcagccccuucaaugagugagguggcccuugucagauacaucaacccggauacuggucgggcacuguucgaggccaagcuccacagagcugguuucaugacagucucaagcaacaccagugccccggugguugugccugccaacggauacuuuagauuugauucuugggugaaccaauucuauucucucgcccccaugggaacuggaaaugggcguagaaggguucaauaa

SEQ ID NO: 4844 - RNA, 1629 nt, Artificial Sequence
  VP1,_capsid_protein__Norovirus__BAL60819
augaagauggcgucgaaugacgccgcuccaucuacugauggugcagccggccucgugccagaaaguaauaaugaggucauggcucuugaacccguggcuggugccgccuuggcagccccggucaccggucaaacaaauauuauagacccuuggauuagagcaaauuuuguccaggcccccaauggugaauuuacagucucuccccguaaugccccuggugaagugcuauugaaucuagaguuggguccagaauuaaauccuuaucuggcacauuuagcaagaauguacaacggguaugccggugggauggaggugcaggucauguuggcugggaacgcguucacagccggcaaguuggucuucgccgcugugccaccucacuucccgauugaaaaccuuagcccacagcaaauuacuauguuuccucaugugauuauagauguaaggacuuuggaacccguuuuauuaccacucccugauguuagaaauaauuucuuccacuauaaucagaaagaugaucccaagaugagaaucguggcuaugcuuuacaccccccuuaggucuaaugguucaggugaugacguauucacagucuccugcaggguguugacuagacccuccccugauuuugauuucacauaccuggugccaccaacaguggagucuaaaacaaaaccauucacccucccaauucucacacuuggggaacuuuccaauucuagauucccaguguccauagaccagauguacaccagccccaaugaagucauaucagugcagugucaaaaugguaggugcacacuggauggggagcuccaaggaacgacccaacuccaggucaguggcauuugugcuuuuaagggagaaguaacugcccacuugcacgacaaugaucaccuauacaacaucaccaucacaaacuugaauggguccccuuuugaucccuccgaggacaucccugccccccugggcguaccugacuuucagggaagagucuuugguaucaucucccaaagagacaagcacaauuccccuggacauaaugaaccagcaaauagaggacacgacgcuguggucccuaccuacacagcacaguacacuccaaaauugggucagauucaaauuggcacauggcagaccgacgaucucacagucagccaaccaguaaaauucaccccaguuggacucaaugauacugaacauuuuaaccaaugggugguuccuagauaugcuggugcucuaaaucuuaauacaaaucuugccccuucuguugcuccaguauuuccaggggagcgccuacucuuuuucagaucauauaucccccucaagggugguuauggaaauccagccauugauugccuacuaccacaagagugggugcaacauuucuaccaggaagcagccccuucaaugagugagguggcccuugucagauacaucaacccggauacuggucgggcacuguucgaggccaagcuccacagagcugguuucaugacaguuucaagcaacaccagugccccggugguugugccugccaacggauacuuuagauuugauucuugggugaaccaauucuauucucucgcccccaugggaacugggaaugggcguagaaggguucaauaa

SEQ ID NO: 4845 - RNA, 1629 nt, Artificial Sequence; identical to SEQ ID NO: 4844
  VP1,_capsid_protein__Norovirus__BAL60821

SEQ ID NO: 4846 - RNA, 1629 nt, Artificial Sequence
  VP1,_capsid_protein__Norovirus__BAL60823
augaagauggcgucgaaugacgccgcuccaucuacugauggugcagccggccucgugccagaaaguaauaaugaggucauggcucuugaacccguggcuggugccgccuuggcagccccggucaccggucaaacaaauauuauagacccuuggauuagagcaaauuuuguccaggcccccaauggugaauuuacagucucuccccguaaugccccuggugaagugcuauugaaucuagaguuggguccagaauuaaauccuuaucuggcacauuuagcaagaauguacaacggguaugccgguggguuggaggugcaggucauguuggcugggaacgcguucacagccggcaaguuggucuucgccgcugugccaccucacuucccgauugaaaaccuuagcccacagcaaauuaccauguuuccucaugugauuauagauguaaggacuuuggaacccguuuuauuaccacucccugauguuagaaauaauuucuuccacuauaaucagaaagaugaucccaagaugagaaucguggcuaugcuuuacaccccccuuaggucuaaugguucaggugaugacguauucacagucuccugcaggguguugacuagacccuccccugauuuugauuucacauaccuggugccaccaacaguggagucuaaaacaaaaccauucacccucccaauucucacacuuggggaacuuuccaauucuagauucccaguguccauagaccagauguacaccagccccaaugaagucauaucagugcagugucaaaaugguaggugcacacuggauggggagcuccaaggaacgacccaacuccaggucaguggcauuugugcuuuuaagggagaaguaacugcccacuugcaugacaaugaucaccuauacaacaucaccaucacaaacuugaauggguccccuuuugaucccuccgaggacaucccugccccccugggcguaccugacuuucagggaagagucuuugguaucaucucccaaagagacaagcacaauuccccuggacauaaugaaccagcaaauagaggacacgacgcuguggucccuaccuacacagcacaguacacuccaaaauugggucagauucaaauuggcacauggcagaccgacgaucucacagucagccaaccaguaaaauucaccccaguuggacucaaugauacugaacauuuuaaccaaugggugguuccuagauaugcuggugcucuaaaucuuaauacaaaucuugccccuucuguugcuccaguauuuccaggggagcgccuacucuuuuucagaucauauaucccccucaagggugguuauggaaauccagccauugauugccuacuaccacaagagugggugcaacauuucuaccaggaagcagccccuucaaugagugagguggcccuugucagauacaucaacccggauacuggucgggcacuguucgaggccaagcuccacagagcugguuucaugacaguuucaagcaacaccagugccccggugguugugccugccaacggauacuuuagauuugauucuugggugaaccaauucuauucucucgcccccaugggaacugggaaugggcguagaaggguucaauaa

SEQ ID NO: 4847 - RNA, 1629 nt, Artificial Sequence
  VP1,_capsid_protein__Norovirus__BAL60825
augaagauggcgucgaaugacgccgcuccaucuacugauggugcagccggccucgugccagagaguaauaaugaggucauggcucuugaacccguggcuggugccgccuuggcagccccagucaccggucaaacaaauauuauagacccuuggauuagagcaaauuuuguccaggcccccaauggugaauuuacagucucuccccguaacuccccuggugaagugcuauugaaucuagaguuggguccagaauuaaauccuuaucuggcacauuuagcaagaauguacaauggguaugccggugggauggaggugcaggucauguuggcugggaacgcguucacagccggcaaguuagucuucgccgcugugccaccucacuucccggucgaaaaccuuagcccacagcaaauuaccauguucccucaugugauuauagaugucaggacuuuggaaccuguuuuauuaccacucccugauguuaggaauaacuucuuccauuacaaucagaaagaugaucccaagaugagaauuguggcuaugcuuuauaccccccuuaggucuaaugguucaggugaugauguguuuacagucuccugcaggguguugacuagacccuccccugauuuugauuucacauaucuggugccuccaacaguggaaucuaaaacaaaaucauucacucucccaauccucacucuuggggaacuuuccaauuccagauucccaguguccauagaccagauguacaccagccccaaugaagucauaucagugcagugucaaaauggcaggugcacacuggauggggaacuucaaggaacaacacaacuccagguuaguggcauuugugcuuucaagggagaagugacugcccacuugcaugauaaugaucaccuguauaaugucaccaucacaaacuuaaauggguccccuuuugaccccuccgaggacauccccgccccucugggcguaccugacuuucagggaagggucuuuggugucaucucccaaagagacaaacacaauaccccuggacauaaugaaccagcaaacagggcacacgaugccguggucccuacuuacacagcacaguacaccccaaaauugggucagauucaaauuggcacauggcagacugaugaucucacagucaaccaaccagucaauuucaccccaguuggacuuagugauacugaccauuuuaaccaaugggugguccccagguaugcuggugcccuaaaccuuaacacaaaccuugccccuucuguugcuccaguuuuuccaggggagcgccugcucuuuuucagaucauacaucccccucaagggugguuauggaacuccagccauugauugccuacuaccacaagagugggugcaacauuucuaucaggaagcagccccuucgaugagugagguggcccuugucagauacaucaacccggauacuggucgggcacuguuugaggccaaacuccacagagcugguuucaugacagucucaagcaacaccagugccccggugguugugccugccaacggauacuucagauuugauucuugggugaaccaauucuauucucucgcccccaugggaacuggaaaugggcguagaaggauccaauaa

SEQ ID NO: 4848 - RNA, 1629 nt, Artificial Sequence; identical to SEQ ID NO: 4831
  VP1,_capsid_protein__Norovirus__BAL60827

SEQ ID NO: 4849 - RNA, 1629 nt, Artificial Sequence
  VP1,_capsid_protein__Norovirus__BAL60829
augaagauggcgucgaaugacgccgcuccaucuacugauggugcagccggccucgugccagaaaguaauaaugaggucauggcucuugaacccguggcuggugccgccuuggcagccccggucaccggucaaacaaauauuauagacccuuggauuagagcaaauuuuguccaggcccccaauggugaauuuacagucucuccccguaaugccccuggugaagugcuauugaaucuagaguuggguccagaauuaaauccuuaucuggcacauuuagcaagaauguacaacggguaugccggugggauggaggugcaggucauguuggcugggaacgcguucacagccggcaaguuggucuucgccgcugugccaccucacuucccgauugaaaaccuuagcccacagcaaauuacuauguuuccucaugugauuauagauguaaggacuuuggaacccguuuuauuaccacucccugauguuagaaauaauuucuuccacuauaaucagaaagaugaucccaagaugagaaucguggcuaugcuuuacaccccccuuaggucuaaugguucaggugaugacguauucacagucuccugcaggguguugacuaggcccuccccugauuuugauuucacauaccuggugccaccaacaguggagucuaaaacaaaaccauucacccucccaauucucacacuuggggaacuuuccaauucuagauucccaguguccauagaccagauguacaccagccccaaugaagucauaucagugcagugucaaaaugguaggugcacacuggauggggagcuccaaggaacgacccaacuccaggucaguggcauuugugcuuuuaagggagaaguaacugcccacuugcaugacaaugaucaccuauacaacaucaccaucacaaacuugaauggguccccuuuugaucccuccgaggacaucccugccccccugggcguaccugacuuucagggaagagucuuugguaucaucucccaaagagacaagcacaauuccccuggacauaaugaaccagcaaauagaggacacgacgcuguggucccuaccuacacagcacaguacacuccaaaauugggucagauucaaauuggcacauggcagaccgacgaucucacagucagccaaccaguaaaauucaccccaguuggacucaaugauacugaacauuuuaaccaaugggugguuccuagauaugcuggugcucuaaaucuuaauacaaaccuugccccuucuguugcuccaguauuuccaggggagcgccuacucuuuuucagaucauauaucccccucaagggugguuauggaaauccagccauugauugccuacuaccacaagagugggugcaacauuucuaccaggaagcagccccuucaaugagugagguggcccuugucagauacaucaacccggauacuggucgggcacuguucgaggccaagcuccacagagcugguuucaugacaguuucaagcaacaccagugccccggugguugugccugccaacggauacuuuagauuugauucuugggugaaccaauucuauucucucgcccccaugggaacugggaaugggcguagaaggguucaauaa

SEQ ID NO: 4850 - RNA, 1629 nt, Artificial Sequence
  VP1,_capsid_protein__Norovirus__BAL60831
augaagauggcgucgaaugacgccgcuccaucuacugauggugcagccggccucgugccagaaaguaauaaugaggucauggcucuugaacccguggcuggugccgccuuggcagccccggucaccggucaaacaaauauuauagacccuuggauuagagcaaauuuuguccaggcccccaauggugaauuuacagucucuccccguaaugccccuggugaagugcuauugaaucuagaguuggguccagaauuaaauccuuaucuggcacauuuagcaagaauguacaacggguaugccggugggauggaggugcaggucauguuggcugggaacgcguucacagccggcaaguuggucuucgccgcugugccaccucacuucccaauugaaaaccuuagcccacagcaaauuaccauguuuccucaugugauuauagauguaaggacuuuggaacccguuuuauuaccacucccugauguuagaaauaauuucuuccacuauaaucagaaagaugaucccaagaugagaaucguggcuaugcuuuacaccccccuuaggucuaaugguucaggugaugacguauucacggucuccugcaggguguugacuagacccuccccugauuuugauuucacauaccuggugccaccaacaguggagucuaaaacaaaaccauucacccucccaauucucacacuuggggaacuuuccaauucuagauucccaguguccauagaccagauguacaccagccccaaugaagucauaucagugcagugucaaaaugguaggugcacacuggauggggagcuccaaggaacgacccaacuccaggucaguggcauuugugcuuuuaagggagaaguaacugcccacuugcaugacaaugaucaccuauacaacaucaccaucacaaacuugaauggguccccuuuugaucccuccgaggacaucccugccccccugggcguaccugacuuucagggaagagucuuugguaucaucucccaaagagacaagcacaauuccccuggacauaacgaaccagcaaauagaggacacgacgcuguggucccuaccuacacagcacaguacacuccaaaauugggucagauucaaauuggcacauggcagaccgacgaucucacagucagccaaccaguaaaauucaccccaguuggacucaaugauacugaacauuuuaaccaaugggugguuccuagauaugcuggugcucuaaaucuuaauacaaaucuugccccuucuguugcuccaguauuuccaggggagcgccuacucuuuuucagaucauauaucccccucaagggugguuauggaaauccagccauugauugccuacuaccacaagagugggugcaacauuucuaccaggaagcagccccuucaaugagugagguggcccuugucagauacaucaacccggauacuggucgggcacuguucgaggccaagcuccacagagcugguuucaugacaguuucaagcaacaccagugccccggugguugugccugccaacggauacuuuagauuugauucuugggugaaccaauucuauucucucgcccccaugggaacugggaaugggcguagaaggguucaauaa

SEQ ID NO: 4851 - RNA, 1629 nt, Artificial Sequence
  VP1,_capsid_protein__Norovirus__BAL60833
augaagauggcgucgaaugacgccgcuccaucuacugauggugcagccggccucgugccagagaguaauaaugaggucauggcucuugaacccguggcuggugccgccuuggcagccccagucaccggccaaacaaauauuauagacccuuggauuagagcaaauuuuguccaggcccccaauggugaauuuacagucucuccccguaacuccccuggugaagugcuauugaaucuagaguuggguccagaauuaaauccuuaucuggcacauuuagcaagaauguacaauggguaugccggugggauggaggugcaggucauguuggcugggaacgcguucacagccggcaaguuagucuucgccgcugugccaccucacuucccggucgaaaaccucagcccacagcaaauuaccauguucccucaugugauuauagaugucaggacuuuggaaccuguuuuguuaccacucccugauguuaggaauaacuucuuccauuacaaucagaaagaugaucccaagaugagaauuguggcuaugcuuuauaccccccuuaggucuaaugguucaggugaugauguguuuacagucuccugcaggguguugacuagacccuccccugauuuugauuucacauaucuggugccuccaacaguggaaucuaaaacaaaaccauucacucucccaauccucacucuuggggaacuuuccaauuccagauucccaguguccauagaccagauguacaccagccccaaugaagucauaucagugcagugucaaaauggcaggugcacacuggauggggaacuucaaggaacaacacaacuccaggucaguggcauuugugcuuucaagggagaagugacugcccacuugcaugauaaugaucaccuguauaaugucaccaucacaaacuuaaauggguccccuuuugaccccuccgaggacauccccgccccucugggcguaccugacuuucagggaagggucuuuggugucaucucccaaagagacaaacacaauaccccuggacauaaugaaccagcaaacagggcacacgaugccguggucccuacuuacacagcacaguacaccccaaaauugggucagauucaaauuggcacauggcagacugaugaucucacggucaaccaaccagucaauuucaccccaguuggacuuaaugauacugaccauuuuaaccaaugggugguccccagguaugcuggugcccuaaaccuuaacacaaaccuugccccuucuguugcuccaguauuuccaggggagcgccugcucuuuuucagaucauacaucccccucaagggugguuauggaacuccagccauugauugccuacuaccacaagagugggugcaacauuucuaucaggaagcagccccuucgaugagugagguggcccuugucagauacaucaacccggauacuggucgggcacuguuugaggccaaacuccacagagcugguuucaugacagucucaagcaacaccagugccccggugguugugccugccaacggauacuucagauuugauucuugggugaaccaauucuauucucucgcccccaugggaacuggaaaugggcguagaaggauccaguaa

SEQ ID NO: 4852 - RNA, 1629 nt, Artificial Sequence
  VP1,_capsid_protein__Norovirus__BAL60835
augaagauggcgucgaaugacgccgcuccaucuacugauggugcagccggccucgugccagagaguaauaaugaggucauggcucuugaacccguggcuggugccgccuuggcagccccagucaccggucaaacaaauauuauagacccuuggauuagagcaaauuuuguccaggcccccaauggugaauuuacagucucuccccguaacuccccuggugaagugcuauugaaucuagaguuggguccagaauuaaauccuuaucuggcacauuuagcaagaauguacaauggguaugccggugggauggaggugcaggucauguuggcugggaacgcguucacagccggcaaguuagucuucgccgcugugccaccucacuucccggucgaaaaccuuagcccacagcaaauuaccauguucccucaugugauuauagaugucaggacuuuggaaccuguuuuauuaccacucccugauguuaggaauaacuucuuccauuacaaucagaaagaugaucccaagaugagaauuguggcuaugcuuuauaccccccuuaggucuaaugguucaggugaugauguguuuacagucuccugcaggguguugacuagacccuccccugauuuugauuucacauaucuggugccuccaacaguggaaucuaaaacaaaaccauucacucucccaauccucacucuuggggaacuuuccaauuccagauucccaguguccauagaccagauguacaccagccccaaugaagucauaucagugcagugucaaaauggcaggugcacacuggauggggaacuucaaggaacaacacaacuccaggucaguggcauuugugcuuucaagggagaagugacugcccacuugcaugauaaugaucaccuguauaaugucaccaucacaaacuuaaauggguccccuuuugaccccuccgaggacauccccgccccucugggcguaccugacuuucagggaagggucuuuggugucaucucccaaagagacaaacacaauaccccuggacauaaugaaccagcaaacagggcacacgaugccguggucccuacuuacacagcacaguacaccccaaaauugggucagauucaaauuggcacauggcagacugaugaucucacagucaaccaaccagccaauuucaccccaguuggacuuagugauacugaccauuuuaaccaaugggugguccccagguaugcuggugcccuaaaccuuaacacaaaccuugccccuucuguugcuccaguuuuuccaggggagcgccugcucuuuuucagaucauacaucccccucaagggugguuauggaacuccagccauugauugccuacuaccacaagagugggugcaacauuucuaucaggaagcagccccuucgaugagugagguggcccuugucagauacaucaacccggauacuggucgggcacuguuugaggccaaacuccacagagcugguuucaugacagucucaagcaacaccagugccccggugguugugccugccaacggauacuucagauuugauucuugggugaaccaauucuauucucucgcccccaugggaacuggaaaugggcguagaaggauccaauaa

SEQ ID NO: 4853 - RNA, 1629 nt, Artificial Sequence
  VP1,_capsid_protein__Norovirus__BAL60837
augaagauggcgucgaaugacgccgcuccaucuacugauggugcagccggccucgugccagagaguaauaaugaggucauggcucuugaacccguggcuggugccgccuuggcagccccagucaccggucaaacaaauauuauagacccuuggauuagagcaaauuuuguccaggcccccaauggugaauuuacagucucuccccguaacuccccuggugaagugcuauugaaucuagaguuggguccagaauuaaauccuuaucuggcacauuuagcaagaauguacaauggguaugccggugggauggaggugcaggucauguuggcugggaacgcguucacagccggcaaguuagucuucgccgcugugccaccucacuucccggucgaaaaccuuagcccacagcaaauuaccauguucccucaugugauuauagaugucaggacuuuggaaccuguuuuacuaccacucccugauguuaggaauaauuucuuccauuacaaucagaaagaugaucccaagaugagaauuguggcuaugcuuuauaccccccuuaggucuaaugguucaggugaugauguguuuacagucuccugcaggguguugacuagacccuccccugauuuugauuucacauaucuggugccuccaacaguggaaucuaaaacaaaaccauucacucucccaauccucacucuuggggaacuuuccaauuccagauucccaguguccauagaccagauguacaccagccccaaugaagucauaucagugcagugucaaaauggcaggugcacacuggauggggaacuucaaggaacaacacaacuccaggucaguggcauuugugcuuucaagggagaagugacugcccacuugcaugauaaugaucaccuguauaaugucaccaucacaaacuuaaauggguccccuuuugaccccuccgaggacauccccgccccucugggcguaccugacuuucagggaagggucuuuggugucaucucccaaagagacaaacacaauaccccuggacauaaugaaccagcaaacagggcacacgaugccguggucccuacuuacacagcacaguacaccccaaaauugggucagauucaaauuggcacauggcagacugacgaucucacagucaaccaaccagucaauuucaccccaguuggacuuagugauacugaccauuuuaaccaaugggugguccccagguaugcuggugcccuaaaccuuaacacaaaucuugccccuucuguugcuccaguauuuccaggggagcgccugcucuuuuucagaucauacaucccccucaagggugguuauggaacuccagccauugauugccuacugccacaagagugggugcaacauuucuaucaggaagcagccccuucgaugagugagguggcccuugucagauacaucaacccggauacuggucgggcacuguuugaggccaaacuccauagagcugguuucaugacagucucaagcaacaccagugccccggugguugugccugccaacggauacuuuagauuugauucuugggugaaccaauucuauucucucgcccccaugggaacuggaaaugggcguagaaggauccaauaa

SEQ ID NO: 4854 - RNA, 1629 nt, Artificial Sequence
  VP1,_capsid_protein__Norovirus__BAL60839
augaagauggcgucgaaugacgccgcuccaucuacugauggugcagccggccucgugccagagaguaauaaugaggucauggcucuugaacccguggcuggugccgccuuggcagccccagucaccggucaaacaaauauuauagacccuuggauuagagcaaauuuuguccaggcccccaauggugaauuuacagucucuccccguaacuccccuggugaagugcuauugaaucuagaguuggguccagaauuaaauccuuaucuggcacauuuagcaagaauguacaauggguaugccggugggauggaggugcaggucauguuggcugggaacgcguucacagccggcaaguuagucuucgccgcugugccaccucacuucccggucgaaaaccuuagcccacagcaaauuaccauguucccucaugugauuauagaugucaggacuuuggaaccuguuuuacuaccacucccugauguuaggaauaacuucuuccauuacaaucagaaagaugaucccaagaugagaauuguggcuaugcuuuauaccccccuuaggucuaaugguucaggugaugauguguuuacagucuccugcaggguguugacuagacccuccccugauuuugauuucacauaucuggugccuccaacaguggaaucuaaaacaaaaccauucacucucccaauccucacucuuggggaacuuuccaauuccagauucccaguguccauagaccagauguacaccagccccaaugaagucauaucagugcagugucaaaauggcaggugcacacuggauggggaacuucaaggaacaacacaacuccaggucaguggcauuugugcuuucaagggagaagugacugcccacuugcaugauaaugaucaccuguauaaugucaccaucacaaacuuaaauggguccccuuuugaccccuccgaggacauucccgccccucugggcguaccugacuuucagggaagggucuuuggugucaucucccaaagagacaaacacaauaccccuggacauaaugaaccagcaaacagggcacacgaugccguggucccuacuuacacagcacaguacaccccaaaauugggucagauucaaauuggcacauggcagacugacgaucucacagucaaccaaccagucaauuucaccccaguuggacuuagugauacugaccauuuuaaccaaugggugguccccagguaugcuggugcccuaaaccuuaauacaaaccuugccccuucuguugcuccaguauuuccaggggagcgccugcucuuuuucagaucauacaucccccucaagggugguuauggaacuccagccauagauugccuacugccacaagagugggugcaacauuucuaucaggaagcagccccuucgaugagugagguggcccuugucagauacaucaacccggauacuggucgggcacuguuugaggccaaacuccacagagcugguuucaugacagucucaagcaacaccagugccccggugguugugccugccaacggauacuucagauuugauucuugggugaaccaauucuauucucucgcccccaugggaacuggaaaugggcguagaaggauccaauaa

SEQ ID NO: 4855 - RNA, 1629 nt, Artificial Sequence
  VP1,_capsid_protein__Norovirus__BAL60841
augaagauggcgucgaaugacgccgcuccaucuacugauggugcagccggccucgugccagagaguaauaaugaggucauggcucuugaacccguggcuggugccgccuuggcagccccagucaccggucaaacaaauauuauagacccuuggauuagagcaaauuuuguccaggcccccaauggugaauuuacagucucuccccguaacuccccuggugaagugcuauugaaucuagaguuggguccagaauuaaauccuuaucuggcacauuuagcaagaauguacaauggguaugccggugggauggaggugcaggucauguuggcugggaacgcguucacagccggcaaguuagucuucgccgcugugccaccucacuucccggucgaaaaccuuagcccacagcaaauuaccauguucccucaugugauuauagauguuaggacuuuggaaccuguuuuacuaccacucccugauguuaggaauaacuucuuccauuacaaucagaaagaugaucccaagaugagaauuguggcuaugcuuuauaccccccuuaggucuaaugguucaggugaugauguguuuacagucuccugcaggguguugacuagacccuccccugauuuugauuucacauaucuggugccuccaacaguggaaucuaaaacaaaaccauucacucucccaauccucacucuuggggaacuuuccaauuccagauucccaguguccauagaccagauguacaccagccccaaugaagucauaucagugcagugucaaaauggcaggugcacacuggauggggaacuucaagggacaacacaacuccaggucaguggcauuugugcuuucaagggagaagugacugcccacuugcaugauaaugaucaccuguauaaugucaccaucacaaacuuaaauggguccccuuuugaccccuccgaggacauccccgccccucugggcguaccugacuuucagggaagggucuuuggugucaucucccaaagagacaaacacaauaccccuggacauaacgaaccagcaaacagggcacacgaugccguggucccuacuuacacagcacaguacaccccaaaauugggucagauucaaauuggcacauggcagacugacgaucucacagucaaccaaccagucaaauucaccccaguuggacuuaaugauacugaccauuuuaaccaaugggugguccccagguaugcuggugcccuaaaccuuaacacaaaucuugccccuucuguugcuccaguauuuccaggggagcgccugcucuuuuucagaucauacaucccccucaagggugguuauggaacuucagccauugauugccuacugccacaagagugggugcaacauuucuaucaggaagcagccccuucgaugagugagguggcccuugucagauacaucaacccggauacuggucgggcacuguuugaggccaaacuccacagagcugguuucaugacagucucaagcaacaccagugccccggugguugugccugccaacggauacuucagauuugauucuugggugaaccaauucuacucucucgcccccaugggaacuggaaaugggcguagaaggauccaauga

SEQ ID NO: 4856 - RNA, 1629 nt, Artificial Sequence
  VP1,_capsid_protein__Norovirus__BAL60843
augaagauggcgucgaaugacgccgcuccaucuacugauggugcagccggccucgugccagaaaguaauaaugaggucauggcucuugaacccguggcuggugccgccuuggcagccccggucaccggucaaacaaauauuauagacccuuggauuagagcaaauuuuguccaggcccccaauggugaauuuacagucucuccccguaaugccccuggugaagugcuauugaaucuagaguuggguccagaauuaaauccuuaucuggcacauuuagcaagaauguacaacggguaugccggugggauggaggugcaggucauguuggcugggaacgcguucacagccggcaaguuggucuucgccgcugugccaccucacuucccgauugaaaaccuuagcccacagcaaauuaccauguuuccucaugugauuauagauguaaggacuuuggaacccguuuuauuaccacucccugauguuagaaauaauuucuuccacuauaaucagaaagaugaucccaagaugagaaucguggcuaugcuuuacaccccccuuaggucuaaugguucaggugaugacguauucacagucuccugcaggguguugacuagacccuccccugauuuugauuucacauaccuggugccaccaacaguggagucuaaaacaaaaccauucacccucccaauucucacacuuggggaacuuuccaauucuagauucccaguguccauagaccagauguacaccagccccaaugaagucauaucagugcagugucaaaaugguaggugcacacuggauggggagcuccaaggaacgacccaacuccaggucaguggcauuugugcuuuuaagggagaaguaacugcccacuugcaugacaaugaucaccuauacaacaucaccaucacaaacuugaauggguccccuuuugaucccuccgaggacaucccugccccccugggcguaccugacuuucagggaagagucuuugguaucaucucccaaagagacaagcacaauuccccuggacauaaugaaccagcaaauagaggacacgacgcuguggucccuaccuacacagcacaguacacuccaaaauugggucagauucaaauuggcacauggcagaccgacgaucucacagucagccaaccaguaaaauucaccccaguuggacuuaaugauacugaacauuuuaaccaaugggugguuccuagauaugcuggugcucuaaaucuuaauacaaaucuugccccuucuguugcuccaguauuuccaggggagcgccuacucuuuuucagaucauauaucccccucaagggugguuauggaaauccagccauugauugccuacuaccacaagagugggugcaacauuucuaccaggaagcagccccuucaaugagugagguggcccuugucagauacaucaacccggauacuggucgggcacuguucgaggccaagcuccacagagcugguuucaugacaguuucaagcaacaccagugccccggugguugugccugccaacggauacuuuagauuugauucuugggugaaccaauucuauucucucgcccccaugggaacugggaaugggcguagaaggguucaauaa

SEQ ID NO: 4857 - RNA, 1629 nt, Artificial Sequence
  VP1,_capsid_protein__Norovirus__BAL60845
augaagauggcgucgaaugacgccgcuccaucuacugauggugcagccggccucgugccagagaguaauaaugaggucauggcucuugaacccguggcuggugccgccuuggcagccccagucaccggucaaacaaauauuauagacccuuggauuagagcaaauuuuguccaggcccccaauggugaauuuacagucucuccccguaacuccccuggugaagugcuauugaaucuagaguuggguccagaauuaaauccuuaucuggcacauuuagcaagaauguacaauggguaugccggugggauggaggugcaggucauguuggcugggaacgcguucacagccggcaaguuagucuucgccgcugugccaccucacuucccggucgaaaaccuuagcccacagcaaauuaccauguucccucaugugauuauagaugucaggacuuuggaaccuguuuuauuaccacucccugauguuaggaauaacuuuuuccauuacaaucagaaagaugaucccaagaugagaauuguggcuaugcuuuauaccccccuuaggucuaaugguucaggugaugauguguuuacagucuccugcaggguguugacuagacccuccccugauuuugauuucacauaucuggugccuccaacaguggaaucuaaaacaaaaccauucacucuuccaauccuuacucuuggggaacuuuccaauuccagauucccaguguccauagaccagauguacaccagccccaaugaagucauaucagugcagugucaaaauggcaggugcacacuggauggggaacuucaaggaacaacacaacuccaggucaguggcauuugugcuuucaagggagaagugacugcccacuugcaugauaaugaucaccuguauaaugucaccaucacaaacuuaaauggguccccuuuugaccccucugaggacauccccgccccucugggcguaccugacuuucagggaagggucuuuggugucaucucccaaagagacaaacacaauaccccuggacauaaugaaccagcaaacagggcacacgaugccguggucccuacuuacacagcacaguacaccccaaaauugggucagauucaaauuggcacauggcagacugacgaucucacagucaaccaaccagucaauuucaccccaguuggacuuaaugauacugaccauuuuaaccaaugggugguccccagguaugcuggugcccuaaaccuuaacacaaaccuugccccuucuguugcuccaguauuuccaggggagcgccugcucuuuuucagaucauacaucccccucaagggugguuauggaacuccagccauugauugccuacuaccacaagagugggugcaacauuucuaucaggaagcagccccuucgaugagugagguggcccuugucagauacaucaacccggauacuggucgggcacuguuugaggccaaacuccacagagcuggcuucaugacagucucaagcaacaccagugccccggugguugugccugccaacggauacuucagauuugauucuugggugaaccaauucuauucucucgcccccaugggaacuggaaaugggcguagaaggauccaauaa

SEQ ID NO: 4858 - RNA, 1629 nt, Artificial Sequence
  VP1,_capsid_protein__Norovirus__BAL60847
augaagauggcgucgaaugacgccgcuccaucuacugauggugcagccggccucgugccagagaguaauaaugaggucauggcucuugaacccguggcuggugccgccuuggcagccccagucaccggucaaacaaauauuauagacccuuggauuagagcaaauuuuguccaggcccccaauggugaauuuacagucucuccccguaauuccccuggugaagugcuauugaaucuagaguuggguccagaauuaaauccuuaucuggcacauuuagcaagaauguacaauggguaugccggugggauggaggugcaggucauguuggcugggaacgcguucacagccggcaaguuagucuucgccgcugugccaccucacuucccggucgaaaaccuuagcccacagcaaauuaccauguucccucaugugauuauagaugucaggacuuuggaaccuguuuuacuaccacucccugauguuaggaauaacuucuuccauuacaaucagaaagaugaucccaagaugagaauuguggcuaugcuuuauaccccccuuaggucuaaugguucaggugaugauguguuuacagucuccugcaggguguugacuagacccuccccugauuuugauuucacauaucuggugccuccaacaguggaaucuaaaacaaaaccauucacucucccaauccucacucuuggggaacuuuccaauuccagauucccaguguccauagaccagauguacaccagccccaaugaagucauaucagugcagugucaaaauggcaggugcacacuggauggggaacuucaaggaacaacacaacuccaggucaguggcauuugugcuuucaagggagaagugacugcccacuugcaugauaaugaucaccuguauaaugucaccaucacaaacuuaaauggguccccuuuugaccccuccgaggacauccccgccccucugggcguaccugacuuucagggaagggucuuuggugucaucucccaaagagacaaacacaauaccccuggacauaaugaaccagcaaacagggcacacgaugccguggucccuacuuacacagcacaguacaccccaaaauugggucagauucaaauuggcacauggcagacugacgaucucacagucaaccaaccagucaauuucaccccaguuggacuuagugauacugaccacuuuaaccaaugggugguccccagguaugcuggugcccuaaaccuuaacacaaaucuugccccuucuguugcuccaguauuuccaggggagcgccugcucuuuuucagaucauacaucccccucaagggugguuauggaacuccagccauugauugccuacugccacaagagugggugcaacauuucuaucaggaagcagccccuucgaugagugagguggcccuugucagauacaucaacccggauacuggucgggcacuguuugaggccaaacuccacagagcugguuucaugacagucucaagcaacaccagugccccggugguugugccugccaacggauacuucagauuugauucuugggugaaucaauucuacucucucgcccccaugggaacuggaaaugggcguagaaggauccaauaa

SEQ ID NO: 4859 - RNA, 1629 nt, Artificial Sequence
  VP1,_capsid_protein__Norovirus__BAL60849
augaagauggcgucgaaugacgccgcuccaucuacugauggugcagccggccucgugccagaaaguaauagugaggucauggcucuugaacccguggcuggugccgccuuggcagccccggucaccggucaaacaaauauuauagacccuuggauuagagcaaauuuuguccaggcccccaauggugaauuuacagucucuccccguaaugccccuggugaagugcuauugaaucuagaguuggguccagaauuaaauccuuaucuggcacauuuagcaagaauguacaacggguaugccggugggauggaggugcaggucauguuggcugggaacgcguucacagccggcaaguuggucuucgccgcugugccaccucacuucccgauugaaaaccuuagcccacagcaaauuaccauguuuccucaugugauuauagauguaaggacuuuggaacccguuuuauuaccacucccugauguuagaaauaauuucuuccacuauaaucagaaagaugaucccaagaugagaaucguggcuaugcuuuacaccccccuuaggucuaaugguucaggugaugacguauucacagucuccugcaggguguugacuagacccuccccugauuuugauuucacauaccuggugccaccaacaguggagucuaaaacaaaaccauucacccucccaauucucacacuuggggaacuuuccaauucuagauucccaguguccauagaccagauguacaccagccccaaugaagucauaucagugcagugucaaaaugguaggugcacacuggauggggagcuccaaggaacgacccaacuccaggucaguggcauuugugcuuuuaagggagaaguaacugcccacuugcaugacaaugaucaccuauacaacaucaccaucacaaacuugaauggguccccuuuugaucccuccgaggacaucccugccccccugggcguaccugacuuucagggaagagucuuugguaucaucucccaaagagacaagcacaauuccccuggacauaaugaaccagcaaauagaggacacgacgcuguggucccuaccuacacagcacaguacacuccaaaauugggucagauucaaauuggcacauggcagaccgacgaucucacagucagccaaccaguaaaauucaccccaguuggacucaaugauacugaacauuuuaaccaaugggugguuccuagauaugcuggugcucuaaaucuuaacacaaaucuugccccuucuguugcuccaguauuuccaggggagcgccuacucuuuuucagaucauacaucccccucaagggugguuauggaaauccagccauugauugccuacuaccacaagagugggugcaacauuucuaccaggaagcagccccuucaaugagugagguggcccuugucagauacaucaacccggauacuggucgggcacuguucgaggccaagcuccacagagcugguuucaugacaguuucaagcaacaccagugccccggugguugugccugccaacggauacuuuagauuugauucuugggugaaccaauucuauucucucgcccccaugggaacugggaaugggcguagaaggguucaauaa

SEQ ID NO: 4860 - RNA, 1629 nt, Artificial Sequence; identical to SEQ ID NO: 4831
  VP1,_capsid_protein__Norovirus__BAL60851

SEQ ID NO: 4861 - RNA, 1647 nt, Artificial Sequence
  VP1__Norovirus__AAT00378
augaagauggcgucgaaugacgccacuccauccaaugauggugccgccggccucgucccagagaucaacaaugaggcaauggcgcuagauccaguggcgggugcagcgauagcagcaccccucacuggucagcaaaacauaauugaucccuggauuaugaauaauuuugugcaagcaccugguggugaguuuacaguauccccuaggaauuccccuggugaagugcuucuuaauuuggaauugggcccagaaauaaaccccuauuuggcccaucuugcuagaauguauaaugguuaugcagguggauuugaagugcagguaguccuggcuggaaaugcguuuacagcaggaaagauaaucuuugcagcuauacccccuaauuuuccaauugauaaucugagcgcagcacagaucacaaugugcccgcaugugauuguggaugucagacaguuggaaccggucaaccuuccgaugccugacguucgcaacaacuucuuucauuacaaucaagggucugauucgagauugcgcuuaauugcaaugcuguauacaccucuuagggcaaauaauucuggggaugauguuuuuacugugucuuguagaguguugacuaggccuagcccugacuuuucauuuaauuuccuugugccaccuacuguggagucaaagacaaaacccuucacccucccuauucugacuaucucugaaauguccaauucuagguuuccagugccgauugauucucugcacaccagcccaacugagaauauuguuguccagugccaaaaugggcgcgucacucuugauggugaguugaugggcaccacccaacucuugccgagucaaaucugugcuuuuaggggcgugcucaccagaucaacaagcagggccagugaucaggccgacacaguaaccccuagguuguuuaauuauuauuggcauauacaauuggauaaucuaaaugggacuccuuaugauccugcagaagacauaccaggcccccuagggacaccagauuuccggggcaaagucuuuggcguggccagccagagaaaccccgacagcacaacuagagcacaugaagcaaagguggacacaacagcuggucguuucaccccaaaauuaggcucauuagaaauauccacugaaucugaugacuuugaccaaaaccaaccaacaagauucgccccaguuggcauugggguugaccgugaggcaggcuuucaacaauggucuuugcccgacuauucuggucaguucucccgcaucaugagcuuggccccagcuguugcucccaucuucccuggugagcagcuccuuuucuuccgcucacaguuaccaucuucuggugggcgauccaacgggauuuuagacugccuggucccccaagaauggguucagcacuucuaccaagaaucggcccccgcccaaacacaaguggcccugguuagguaugucaauccugacacugguagagugcuauuugaggccaagcugcacaaauuagguuucaugacuauagcuaagaauggugacucuccaauaaccgucccuccaaauggauacuuuagguuugaaucuugggugaaccccuuuuauacacuugcccccaugggaacugggaaugggcguagaaggauucaauaa

SEQ ID NO: 4862 - RNA, 1626 nt, Artificial Sequence
  VP1__Norovirus__ABD95934
augaagauggcgucgaaugacgccgcuccaucuaaugauggugcugcgggccucgucccagagaucaacaccgagacccuuccccuggaaccaguggcuggugcagcucuugcugcggcugucacuggucaaaguaauauaauugaucccuggauuagaacaaauuuugugcaagcacccaauggggaguucacuguuucaccuaggaauuccccaggagaaguccuccuaaauuuagaauuagguccugauuuaaauccuuauuuggcacacuuaucuagaauguauaauggguaugcugguggaguggagguccagguucuccuagcagggaacgcguucaccgcuggaaagauccucuucgcugccguaccgccaaauuucccaguugaauucuuaaguccugcccaaaucacuaugcucccacauuugauaguugacgucaggacccuugagccaauuaugauaccccuccccgacgugagaaacaccuucuuccauuacaauaauaggcccucugagcguaugcguuugguggccauguuguacacaccccugagauccaacgguucaggugaugaugucuucacagucucaugcagagugcuaacuagacccacuccagauuuugaauuuaccuaccuaguuccacccucaguagagucuaagacaaagccuuucucucuucccaucuuaaccauuucugaauugacuaauucaagguuuccagcacccauugauucauuguuuacugcccaaaauaacaaucuuaauguccaaugucagaauggucggugcacacuagauggugaguugcagggaaccacccagcugcucccaacuggaauaugugccuucagagggaaaauaucagcagaugugcaaaacagucaccaagacagguggcacaugcaguugacaaaucucaauggaaccccauuugacccaacagaugaugucccagcuccgcuuggcaccccugacuucacaggucuacuguuugggguugcaagucaaagaaacguugguggaacagguaacaacacuaccagggcccacgagguagugauagcaacaacuagcacacaauuuguuccaaaauuggguucuauuaauuuugggagugaaagugaagauuuucaagugggcccaccaaccaaauucacaccaguuggaaucaaaauugaaaccgggcacucuuucagacaaugggacccaccuaacuauucuggagcacugacccucaacaugaaccuugccccaccuguugccccaaauuucccaggugagcagcugcucuucuuuagaucaaauguuccuugugcugguggugucagugaggguaucauugacugccuacugccucaagaguggauacaacauuucuaccaggaauccgcuccaucccaaucagauguggcacugaucagauaugucaacccugacacgggccgcacucucuuugaggcaaaacuccacaggacugguuacauuacuguugcucacucuggugacuauccucuuguuguuccuuccaauggcuacuucagauuugauucuuggauaaaucaauuuuacucacucgcccccaugggaacugggaaugggcgcaggagagugcaguaa

SEQ ID NO: 4863 - RNA, 1623 nt, Artificial Sequence
  VP1__Norovirus__ABG49509
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucacuuggccagaauguacaaugguuaugcagguggcuuugaagugcagguaauccuugcggggaaugcguucaccgccgggaaaaucauauuugcagcagucccaccaaauuucccaacugaaggcuugagccccagccaaguuacuauguucccccauauaauaguagauguuaggcaacuggaaccuguguugauccccuuaccugauguuaggaacaauuucuaucacuacaaccaaucaaaugaccccaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauuccccauuccuuuggaaaaguuguucacggguccuagcggugccuuuguuguucaaccacaaaauggcaggugcacgacugauggcgugcucuuagguacuacccaacugucuccugucaacaucugcaccuucagaggggaugucacccacauugcagacacucauaauuacacaaugaauuuggcuucucaaaauuggaacaauuaugacccaacagaagaaaucccagccccucuggggaccccagauuucgugggaaagauccaaggcaugcucacccaaacuacaaggggggauggcucuacccgcggccacaaagccacagugagcacuggggauguccauuucacuccaaagcugggcaguauucaguucaacacugauacaaacaaugauuuugaaacuggccaaaacacgaaauucaccccagucgguguuguccaggaugguaaugguacccaccagaaugaaccccaacaaugggugcucccaagcuacucagguagaacuggucauaauguacaccuagcccccgccguagcccccacuuuuccgggugagcaacuucuuuucuucagguccacuaugcccggaugcagcggguaccccaacaugaauuuggauugucuacucccccaggaaugggugcaacacuucuaccaagaggcagcuccagcacaaucugauguggcucugcuaagauuugugaauccagacacagguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacgugcauuauaa

SEQ ID NO: 4864 - RNA, 1623 nt, Artificial Sequence
  VP1__Norovirus__ABP88833
augaagauggcgacgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuaggaauaauuuuguacaagccccugguggagaguucacaguauccccuagaaacgcuccaggugaaauacuauggagcgcgcccuuaggcccugaucugaauccauaccuuucucaccuggccagaauguacaaugguuaugcaggugguuuugaaguggagguaauccucgcggggaacgcguucaccgccgggaagaucauauuugcagcagucccaccaaauuucccaacugaaggcuugagccccagccaggucacuauguucccccacauaauaguagauguuaggcaauuggaaccuguguugauccccuuaccugauguuaggaauaauuucuaccauuacaaucaaucaaaugacuccaccauuaaauugauagcaaugcuguacacaccacuuagggcuaauaaugcuggggaugaugucuucacagucucuugucgaguccucacgaggccaucccccgauuuugauuucauauuucuggugccacccacaguugagucaagaaccaaaccauucaccgucccaauuuuaacuguugaggaaaugacuaauucaagauuccccauuccuuuggaaaaauuguucacgggucccagcagugcccuuguuguccaaccacaaaauggcaggugcacgacugauggcgugcucuuaggcacuacccaacugucccccgucaacaucugcaccuucagaggcgaugucacccauauuucagguacucgcaccuacagaaugaauuuggcuucucaaaauuggaacaauuaugacccaacagaagaaaucccagccccucugggaacuccagauuucgugggaaagauccaaggcaugcucacccaaaccacaaagggagacggcucgacccgcggucacaaagcuacagugagcacugggaguguugacuuuacuccaaagcugggcagcguucaguucgccacugauacagacaaugauuuugaaacuggccaaaacacaagguucaccccagucggugucauccaggaugguaguagugcccacagaaaugaaccccaacaauggguacucccagauuacucagguagaacuguucauaauguacaccuagccccugccguagcccccacuuuuccgggugagcaacuuccuuucuucagaucuacuaugcccggaugcaguggguaucccaauauggauuuggauugucuacucccccaggaaugggugcagcacuucuaccaagaggcagccccaucacaaucugauguggcuuuguugagauuugugaauccagacacagguaggguucuguuugagugcaagcuucauaaagcaggcuaugucacaguggcucacacuggccagcaugauuugguuaucccccccaauggcuacuuuagauuugauuccugggucaaccaguccuacacacuugcccccaugggaaauggagcggggcguagacgugcauuauaa

SEQ ID NO: 4865 - RNA, 1623 nt, Artificial Sequence
  VP1__Norovirus__ABY27560
augaagauggcgucgagugacgccagcccaucugauggguccacagccaaccucgucccagaggucaacaaugagguuauggcuuuggagcccguuguuggugccgcaauugcggcaccuguagcgggccaacaaaauguaauugaccccuggauuagaaauaauuuuguacaagccccugguggagaguucacaguauccccuagaaacgcuccaggugaaauacuauggagcgcgcccuugggcccugaucugaaucccuaccuuucucauuuggccagaauguacaaugguuaugcaggugguuuugaagugcagguaauucucgcggggaacgcguucaccgccgggaaaaucauauuugcagcagucccaccaaauuucccaacugaaggcuugagccccagccaggucacuauguucccccauauaauaguagauguuaggcaacuggaaccuguguugauucccuuaccugaugucaggaauaauuucuaucacuauaaucagucaaaugaccccaccauuaaacugauagcaaugcuguacacaccacuuagggcuaauaaugcuggggaugaugucuucacagucucuugccgaguccucacgaggccauccccugauuuugauuuuauauuuuuggugccacccacaguugagucaagaaccaaaccauucaccgucccaauuuuaacuguugaggagaugaccaauucaagauuccccauuccuuuggaaaaguuguucacgggucccagcggugccuuuguuguucaaccacaaaauggcagaugcacgacugauggcgugcucuuagguacuacccaacugucuccuguuaacaucugcacuuucagaggggaugucacccacauugcaggcacucaugauuauacaaugaauuuggcuucucaaaauuggaacaauuacgacccaacagaagaaaucccagccccucugggaacuccagauuucgugggaaagauccaaggcgugcucacucaaaccacaaggggagauggcucgacccguggccacaaagccacagugagcacugggaguguccacuuuacuccaaagcugggcaguguucaauucaccacugacacaaacaaugaucuugaaacuggccaaaacacgaaauucaccccagucggugucguccaggaugguaauagugcccaccaaaaugaaccccaacaaugggugcucccaaauuacucagguagaacuggccauaauguacaccuagccccugccguagcccccacuuuuccgggugagcaacuucucuucuucagguccacuaugcccggaugcagcggguaucccaacaugaauuuggauugccuacucccccaggaaugggugcugcacuucuaccaagaggcagcuccagcacaaucugauguggcucugcugagauuugugaauccagacacagguaggguccuguuugagugcaaacuucauaaaucaggcuaugucacaguggcucacacuggcccgcaugauuuggucaucccccccaauggcuacuucagauuugauuccuggguuaaccaauucuacacgcuugcccccaugggaaauggagcggggcguagacgugcguuauaa

SEQ ID NO: 4866 - RNA, 1620 nt, Artificial Sequence
  VP1__Norovirus__ACT76139
augaagauggcgucgagugacgccaacccaucugauggguccgcagccaaccucgucccagaggucaacaaugagguuauggcuuuggagccuguuguuggugcugccauugcagcaccuguggcaggccaacaaaauauaauugaccccuggauuagaaauaauuuuguacaagccccugguggagaguucacaguguccccuagaaacgcuccaggugagauacuauggagcgcgcccuugggcccugauuugaaccccuaucuuucucaccuguccagaauguacaaugguuaugcaggugguuuugaagugcaagugauccucgcagggaacgcguucaccgccgggaaagucauauuugcagcaguuccaccaaauuuuccaacugaaggucuaagccccagccagguuacuauguucccccauauaauuguagauguuaggcaauuggaaccuguauugaucccccuaccugauguuaggaauaauuucuaucauuauaaucaagcacaugauucuacucucaaauugauagcaauguuguacacaccacucagagcuaauaaugccggggaugaugucuuuacagucucuugucgaguccucacgagaccaucccccgauuuugauuuuauauuccuggugccacccacaguugaaucaagaacuaaaccauuuacugucccaaucuuaacuguugaggaaauguccaauucaagauuccccauuccuuuggaaaagcuguacacggguccuagcagugcuuuuguuguccaaccacaaaauggcagaugcacgacugauggcgugcucuuaggcacuacucagcugucagcugucaauaucugcaacuucaggggggaugucacccguguugggaucagccaugauuauacaaugaauuuggugucccaaaauuggaauaauuaugauccaacagaagaaauuccagcuccccugggaacaccagacuuuguaggaaagauccaagguuugcucacccaaaccacaagagcggacggcucgacccgcgcccacaaagcuacagugagcacugggaguguccacuucacuccaaagcuggguaguguucaauucaccaccgauacgaacaaugauuuccaaacuggccaaaacacaaaauuuaccccaguuggugucauccaagacggugaucaccaucagaaugaaccccaacaauggguacucccaaauuacucaggcacaucuggucacaaugugcaucuggccccugccguugcccccacuuucccgggugagcagcuucuuuucuuuagguccacuaugcccggguguagcggguaccccaacaugaauuuggauugccuacucccccaggagugggugcugcacuuuuaccaggaagcagccccagcacaauccgauguggcccugcugagauuugugaauccagacacagguaggguucuguuugagugcaaacuccauaagucaggcuauaucacaguggcucauacuggcccguaugauuugguuaucccccccaaugguuacuucagauuugauucuugggucaaccaguucuacacacucgcccccaugggaaauggaacggggcgcaggcgugcuuuauaa

SEQ ID NO: 4867 - RNA, 1620 nt, Artificial Sequence
  VP1__Norovirus__ACT76142
augaagauggcgucgagugacgccaacccaucugauggguccacagccaaccucgucccagaggucaacaaugagguuauggcuuuggagccuguugucggugcugccauugcagcaccuguggcaggccaacaaaauauaauugaccccuggauuagaaauaauuuugugcaagccccugguggagaguucacaguguccccuagaaaugcuccaggugagauacuauggagcgcgcccuugagcccugauuugaaccccuaucuuucucaccuguccagaauguacaaugguuaugcagguggcuuugaagugcagguaauccucgcagggaaugcguucacugccgggaaaaucauauuugcagcaauuccaccaaauuuuccaacugaaggcuuaagcccuagccagguuacaauguucccccacauaauuguagaugucaggcaauuggaaccuguauuaaucccccuaccugauguuaggaauaauuucuaucauuauaaucaagcacaugauucuacucucaaauugauagcaauguuguauacaccacucagagccaauaaugccggggaugaugucuucacagucucuugucgaguccucacgagaccaucccccgauuuugauuucauauuccuggugccacccacagucgagucaagaacuaagccauucacugucccuaucuuaacuguugaggaaauguccaauucaagauuccccauucccuuagaaaaguuguauacggguccuagcagugcuuuuguuguucaaccacaaaauggcagaugcacgacugauggcgugcuucuaggcacuacucaguugucagcugucaauaucuguaauuucaggggggaugucacccguguugggaucagccaugauuacacaaugaauuuggugucccaaaauuggaauaacuaugauccaacagaggaaaucccugcuccccugggaacaccagacuuuguggguaagauccaaggucugcucacucaaaccacaagagcagacggcucgacucgugcccacaaagccacagugagcacugggagcguucacuucaccccaaagcuggguaguguccaauucaccaccgacacaaacaaugacuuucaaacuggccaaaauacaaaauucaccccaguuggugucauccaagauggugaucaccaccagaaugaaccccaacaaugggugcucccaaauuacucaggcaccucuggucacaaugugcaucuggccccugccguugcucccacuuuccccggugagcagcuucuuuucuuuagguccaccaugcccgggugcagcggguacccuaacaugaauuuggauugccugcucccacaggagugggugucgcacuucuaucaggaagcagccccagcacaaucagauguggcccugcugagauuugugaauccagauacagguaggguuuuguuugagugcaaacuccauaaaucaggcuacaucacaguggcucacacugguccguaugauuugguuauuccccccaaugguuauuucagauuugauucuugggucaaccaguuuuacacacuugcccccaugggaaauggaucggggcgcaagcguguguuauaa

SEQ ID NO: 4868 - RNA, 1620 nt, Artificial Sequence
  VP1__Norovirus__ACT76145
augaagauggcgucgagugacgccaacccaucugauggguccgcagccaaccucgucccagaggucaacaaugagguuauggcucuggagcccguuguuggugcugcuauugcagcaccuguagcgggccaacaaaauauaauugaccccuggauuagaaacaauuuuguacaagccccugguggugaguuuacaguguccccuagaaacgcuccaggugagauacuauggagcgcgcccuugggcccugauuugaaccccuaucuuucucaucuguccagaauguacaaugguuaugcaggugguuuugaagugcaaguaauucucgcggggaacgcguucaccgccgggaaaguuauauuugcggcaguuccaccaaacuuuccaacugaaggcuuaagccccagccaggucacuauguucccccauauaauuguagauguuaggcaauuggaaccuguguugaucccccuaccugauguuaggaauaauuucuaucauuauaaucaaucacaugauucuacccuuaagcugauagcaauguuguauacaccacucagagcuaauaaugccggggaugaugucuucacagucucuugucgaguucucacgaggccaucccccgauuuugauuuuauauuccuugugccacccacaguugaaucaagaaccaaaccauucacugucccaaucuuaacuguugaggaaaugucuaauucaagauuccccauuccuuuggaaaaguuauauacggguccuagcagugcuuuuguuguccaaccacaaaauggcagauguacgacugauggcgugcucuuaggcacuacccagcugucagcugucaauaucuguaacuucaggggggaugucacccacauugugggcagccaugauuauacaaugaaucugguaucccaaaauuggagcaauuaugacccaacagaagaaaucccagccccccugggaacaccagauuucgugggaaagauccaaggccugcucacccagaccacaagagcggauggcucgacccgugcccacaaggcuacagugagcacugggagcguccacuucacuccaaagcuggguaguguucaauucaccacugacacaaacaaugauuuccaaacuggccaaaacacgaaauucacaccaguuggcgucauccaagacggugaucaccaccagaaugaaccccaacaaugggugcucccaaauuacucagguagaacuggucauaaugugcaccuggccccugccguugcccccacuuuuccgggugagcaacuccuuuucuucagguccacuaugcccggauguagcggguaccccaacaugaacuuggauugucuacucccccaggaaugggugcugcacuucuaccaggaagcagcuccagcacaauccgauguggcucugcugagauuugugaauccagacacagguaggguccuguuugagugcaagcuccauaagucaggcuauaucacaguggcucacaccggcccguaugauuugguuaucccccccaaugguuauuuuagauuugauuccugggucaaccaguucuacacacuugcccccaugggaaauggaacggggcgcaggcgugcauuauaa

SEQ ID NO: 4869 - RNA, 1620 nt, Artificial Sequence
  VP1__Norovirus__ACT76148
augaagauggcgucgaaugacgccaacccaucugauggguccgcagccaaccucgucccagaggucaacaaugagguuauggcucuggagcccguuguuggugccgcuauugcggcaccuguagcgggccaacaaaauguaauugaucccuggauuagaaauaauuuuguacaagccccugguggagaguucacaguguccccuagaaacgcuccaggugagauacuauggagcgcgcccuugggccccgauuugaaucccuaucuuucccauuuguccagaauguacaaugguuaugcaggugguuuugaagugcaaguaauccucgcggggaacgcguucaccgccgggaaagucauauuugcagcaguuccaccaaacuuuccaacugaaggccuaagccccagccagguuacuauguucccccauauaauuguagauguuaggcaauuggaaccuguguuaaucccccuaccugauguuaggaauaauuucuaccacuacaaucaagcacaugauucuacacuuaaguugauagcaauguuguacacaccacucagagcuaauaaugccggggaugacgucuucacagucucuugucgaguucuuacgaggccaucccccgauuuugauuuuauauuccuggugccacccacaguugaaucaagaacuaaaccauucacugucccaauuuuaacuguugaggaaaugucuaauucaagauuucccauuccuuuagaaaagcuauacacggguccuagcagugcuuuuguuguccaaccacaaaauggcagauguacgacugauggcguacucuuaggcacuacccagcugucagcugucaauaucuguaacuucaggggggaugucacccauauuguggguagccaugacuauacaaugaauuugguaucccaaaauuggagcaauuaugacccaacagaagaaaucccagccccccugggaacgccagauuuugugggaaagauccaaggcuuacucacccagaccacaagagcggacggcucgacccgugcccacaaagcuacagugagcacugggaguguccacuucauuccaaagcuggguaguguccaauucaccacggacacgaauaaugacuuccaaacuggccaaaacacaaaauucaccccaguuggugucauccaagacggugaucaccaucagaaugaaccccaacaauggguacucccaaauuacucagguagaacuggucauaaugugcaucuggccccugccgucgcccccacuuuuccgggcgagcagcuucuuuucuuuagauccacugugcccgguuguagcggguaccccaacaugaaucuggauugccuacucccucaggaaugggugucgcacuuuuaccaggaagcagcuccagcacaauccgauguggcucugcugagauuugugaauccagauacagguaggguucuguuugagugcaagcuccauaaaucaggcuauaucacaguggcucacaccggcccguaugauuugguucucccccccaaugguuauuucagauuugauucuugggucaaccaguucuacacacucgcccccaugggaaauggaacggggcguaggcgugcauuauaa

SEQ ID NO: 4870 - RNA, 1620 nt, Artificial Sequence
  VP1__Norovirus__ACT76151
augaagauggcgucgagugacgccaacccaucugauggguccgcagccaaccucgucccagaggucaacaaugagguuauggcuuuggagccuguuguuggugccgccauugcagcaccuguagcaggccaacaaaauguaauugaccccuggauuagaaauaauuuuguacaagccccugguggagaguuuacaguguccccuagaaacgcuccaggugagauacuauggagcgcgcccuugggcccugauuugaaccccuaucuuucucaccuguccagaauguacaaugguuaugcaggugguuuugaagugcaaguaauccucgcagggaacgcguucacugccgggaaagucauauuugcagcaguuccaccaaauuuuccaacugaaggucuaagccccagccagguuacuauguucccccauauaauuguagauguuaggcaacuggaaccuguauugaucccccuaccugauguuaggaauaauuucuaucauuauaaucaagcacaugauucuacccuaaaauugauagcaauguuguauacaccacucagagcuaauaaugccggagaugaugucuuuacagucucuugucgaguccucacgagaccaucccccgauuuugauuuuauauuccuggugccacccacaguugaaucaagaacuaaaccauuuacugucccaaucuuaacuguugaggaaauguccaauucaagauuccccauuccuuuggaaaagcuguacacggguccuagcagugcuuuuguuguccaaccacaaaauggcagaugcacgacugauggcgugcucuuaggcacuacucagcugucagcugucaauaucugcaacuucaggggggaugucacccguguugggaucagccaugauuauacaaugaauuuggugucccaaaauuggaauaauuaugacccaacagaagaaauuccagcuccccugggaacgccagacuuugugggaaagauccaagguuugcucacccaaaccacaagagcggacgguucgacccgcgcccacaaagcuacagugagcacugggaguguccacuucacuccaaagcuggguaguguucaauucaccaccgauacgaacaaugauuuccaaacuggccaaaacacaaaauuuaccccaguuggugucauccaagacggugaucaccaucagaaugaaccccaacaauggguacucccaaauuacucaggcacaucuggucacaaugugcaucuggccccugccguugcccccacuuucccgggugagcagcuucuuuucuuuagguccacuaugcccggguguagcggguaccccaacaugaauuuggauugccuacucccccaggagugggugcugcacuuuuaccaggaagcagccccagcacaauccgauguggcucuguugagauuugugaauccagacacagguaggguucuguuugagugcaaacuccauaaaucaggcuauaucacaguggcucacaccggcccguaugauuugguuaucccccccaaugguuacuucagauuugauucuugggucaaccaguucuacacacucgcccccaugggaaauggaacggggcgcaggcgugcauuauaa

SEQ ID NO: 4871 - RNA, 1623 nt, Artificial Sequence
  VP1__Norovirus__ACX31821
augaagauggcgucgaaugacgccaacccaucugauggguccacagccaaccucgucccagaggucaacaaugagguuauggcuuuggaacccguuguaggugccgcuauugcggcgccuguagcgggccaacaaaauguaauugaccccuggauuagaaauaauuuuguacaagccccugguggagaguuuacaguguccccuagaaaugcuccaggugagauacuauggagugcgcccuugggcccugauuugaacccuuaccuuucucaucuggccagaauguauaaugguuaugcagguggcuuugaagugcagguaauccuugcggggaacgcguucaccgccggaaaaaucauauuugcagcaguuccaccuaacuuuccaacugaaggcuugagccccagccagguuacuauguucccccauauaauaguagauguuaggcaauuggaaccuguguugauccccuuaccugauguuagaaauaacuucuaucacuacaaccaaucaaaugacccuaccauuaaauugauagcaaugcuguacacaccacuuagggcuaauaaugcuggggaugaugucuucacagucuccugucgaguccucacgagaccauccccugacuuugacuucauauuucugguaccaccaacaguugaaucaagaaccaaaccauuuaccguuccaaucuuaacuguugaggaaaugaccaauucaagauuccccauuccuuuggaaagguuguacacgggucccagcagugcuuuuguuguccagccacaaaacggcaggugcacgacugauggcgugcucuuaggcaccacccagcugucugcugucaacaucugcaccuuuagaggggaugucacccacauugcaggcucucgcaauuauacaaugaauuuggccucucaaaauuggaauaacuaugauccaacagaagaaaucccagccccccuaggcaccccagauuucgugggaaagauucaaggcaugcucacccaaaccacaagaagugacggcucgacccgcggccacaaggccacaguguucacugggagugccgacuucgccccaaaauugggcagaguccaauucgccacugacacagacaacgauuucgaaucuggccaaaacacgaaauucaccccaguuggcgucauccaggaugguuccacuacccaccgaaaugaaccucaacaauggguacucccaaauuacucagguagaacuggucauaaugugcaucuagccccugcugucgccccuacuuacccgggugagcaacuccuuuucuucagguccacuaugcccggauguagcggguaccccaacauggaucuagauugcuugcucccccaggagugggugcagcacuucuaccaagaagcagcuccagcacagucugauguggcucugcuaagauuugugaauccagacacagguaggguucucuuugagugcaagcuccauaaaucaggauaugucacaguggcucacacuggucagcaugauuugguuauuccccccaaugguuauuuuagauuugauuccuggguuaaucaauucuacacacuugcccccaugggaaauggaacggggcguagacgugcuuuauaa

SEQ ID NO: 4872 - RNA, 1623 nt, Artificial Sequence
  VP1__Norovirus__ACX31837
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaauggcuaugcagguggcuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucacuacaaucagucaaaugauucuaccauuaaauugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuauucuucagguccacuaugcccggguguagcggguaucccaacauggauuuggauugccuacucccccaggagugggugcagcacuucuaccaagaggcagcuccagcacaaucugauguggcccuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 4873 - RNA, 1623 nt, Artificial Sequence
  VP1__Norovirus__ACX31841
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaauaauuuuguacaagccccugguggagaguucacaguaucccccagaaacgcuccaggugaaauacuauggagcgcacccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguauacaccacuuagggccaauaaugcuggggaagaugucuucacagucucuugucgaguccucacgaggccgucuccugauuuugauuuuauauuuuuggugccacccacaguugagucaagaacuaaaccauuuacugucccaaucuuaacuguugaagaaaugaccaauucaagauuccccauuccuuuggaaaaguuguuuacgggucccagcggugccuuuguuguccaaccacaaaauggcaggugcacgacugauggcgugcucuuaggcaccacccaacugucuccugucaacaucuguaccuucagaggggaugucacccacauugcagguucucguaauuacacaaugaauuuggcaucucuaaacuggaacaauuaugacccaacagaagaaauuccagccccucugggaacuccagauuucgugggaaagauccaaggugugcucacucaaaccacaaagggagauggcucgacccguggccauaaagcuacaguuuacacugggaguacccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagagauguccauaauguacaccuagccccugcuguagcccccacuuuuccgggugaacaacuucuuuucuucagguccacuaugcccggaugcagcggguaucccaacauggauuuggauugccuacucccccaggagugggugcaacacuucuaccaagaggcagcuccagcgcaaucugauguggcccuauugagauuugugaauccagacacggguaggguccuguuugagugcaaacuucauaaaucaggcuaugucacaguggcucacaccggccaacaugauuuggucaucccccccaauggcuauuuuagguuugauuccuggguuaaucaauucuacacacuugcccccaugggaaauggaacggggcguagacgugcuuuguaa

SEQ ID NO: 4874 - RNA, 1623 nt, Artificial Sequence
  VP1__Norovirus__ACX31851
augaagauggcgucgaaugacgccaacccaucuaauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaacaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcuuuuaggcaccacccaacugucuccugucaacaucugcaccuucagaggggaugucacccacauugcagguucucguaauuacacaaugaauuuggcuucucuaaacuggaacaauuaugacccaacagaagaaauuccagccccuuuaggaacuccagauuucgugggaaagauccaaggugugcucacucaaaccacaaagggagauggcucgacccguggccauaaagcuacaguuuacacugggagugcccccuucacuccaaagcugggcaguguccaauucaguacugauacagaaaaugauuuugaaacucaccaaaacacaaaguucaccccagucggugucauccaggaugguggcaccacccaccgaaaugaaccccaacaaugggugcucccaaguuauucagguagaaaugucccuaauguacaccuagccccugcuguagcccccacuuuuccgggcgaacaacuucuuuucuuuagguccacuaugcccggaugcagcggguaucccaacauggauuuggacugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 4875 - RNA, 1623 nt, Artificial Sequence
  VP1__Norovirus__ACX31856
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucuuaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagucaggucacuauguucccccacauaauaguggauguuaggcaauuggaaccuguguugauccccuuaccugauguuaggaauaauuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcaggcucucguaauuacacaaugaauuuggcuucccuaaauuggaacaauuaugacccaacagaagaaauuccagccccccuaggaacuccagauuucgugggaaagauccaaggugugcucacucaaaccacaaagggagauggcucgacccguggccauaaagcuacagucuacacugggagugcccccuuuacuccaaagcugggcaguguucaauucaguacugauacagaaaaugauuuugaagcucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggauguagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucauaccggccagcaugauuuggucauccccuccaaugguuauuuuagguuugauuccuggguuaaucaauucuacacacuugcccccaugggaaaugggacggggcgcagacguguuuuauaa

SEQ ID NO: 4876 - RNA, 1623 nt, Artificial Sequence
  VP1__Norovirus__ACX31860
augaagauggcgucgaaugacgccaacccaucugauggguccgcagccaaccucgucccagaggucaacaaugagguuauggcucuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaccccuaccuaucucauuuggccagaauguauaaugguuaugcaggugguuuugaagugcaggugauccucgcggggaacgcguucaccgccggaaaaauuauauuugcagcagucccaccaaacuucccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaacugauagcaaugcuguauacaccacuuagggcuaauaaugcuggggacgaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcuuuuaggcaccacccaacugucuccugucaacaucugcaccuucagaggggaugucacccacauugcaggcucucgugauuacacaaugaauuuggcuucucuaaauuggaacaauuacgacccaacagaagaaauuccagccccucuaggaacuccagauuucgugggaaagauccaaggugugcucacucaaaccacagagggggauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguaguaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguagggucuuguuugagugcaaacuucauaaaucaggcuaugucacaguggcucacaccggccagcaugauuuggucaucccccccaauggcuauuuuagguuugauuccuggguuaaucaguucuacacacuugcccccaugggaaauggaacggggcguagacgugcuuuauaa

SEQ ID NO: 4877 - RNA, 1623 nt, Artificial Sequence
  VP1__Norovirus__ACX31864
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauaugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguauacaccacuuagggcuaauaaugcuggggacgaugucuucacaguuucuugucgaguucucacgagaccaucccccgauuuugauuucauauuuuuagugccacccacaguugaaucaagaacuaaaccauucucugucccaauuuuaacuguugaggagaugaccaauucaagguuccccauuccuuuggaaaagcuguucacgggccccaguagugccuuuguuguucaaccacaaaacggcaggugcacgacugauggcgugcuccuagguacuacccaacugucuccugucaacaucugcaccuucagaggggaugucacccauauugcaggcagucguaacuacacaaugaaucuggcuucccaaaauuggaauaguuaugacccaacagaagaaaucccagccccucuaggaacuccagauuucguggggaagauucaaggugugcucacccaaaccacaaggacggauggcucgacccgcggccacaaagcuacaguguacacugggagcgccgacuuuucuccaaaacuggguagaguucaauuugccacugacacagacaaugauuuuguugcuaaccaaaacacaaaguucaccccagucgguguuauccaggaugguaauacugcccaccgaaaugaaccccaacaaugggugcucccaaguuacucaggcagaaauacucauaaugugcaccuggcccccgcuguagcccccacuuuuccgggugagcagcuccucuucuucagaucuaccaugcccggaugcagcggguaccccaacauggauuuggacugucugcucccccaggaaugggugcaguauuucuaccaggaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacucgcccccaugggaaaugggacggggcguagacgugcauuauaa

SEQ ID NO: 4878 - RNA, 1623 nt, Artificial Sequence
  VP1__Norovirus__ACX31889
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauaugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguauacaccacuuagggcuaauaaugcuggggacgaugucuucacaguuucuugucgaguucucacgagaccaucccccgauuuugauuucauauuuuuagugccacccacaguugaaucaagaacuaaaccauucucugucccaauuuuaacuguugaggagaugaccaauucaagguuccccauuccuuuggaaaagcuguucacgggccccaguagugccuuuguuguucaaccacaaaacggcaggugcacgacugauggcgugcuccuagguacuacccaacugucuccugucaacaucugcaccuucagaggggaugucacccauauugcaggcagucguaacuacacaaugaaucuggcuucccagaauuggaauaguuaugacccaacagaagaaaucccagccccucuaggaacuccagauuucguggggaagauucaaggugugcucacccaaaccacaaggacggauggcucgacccgcggccacaaagcuacaguguacacugggagcgccgacuuuucuccaaaacuggguagaguucaauuugccacugacacagacaaugauuuugaugcuaaccaaaacacaaaguucaccccagucgguguuauccaggaugguaauacugcccaccgaaaugaaccccagcaaugggugcucccaaguuacucaggcagaaauacucauaaugugcaccuggcccccgcuguagcccccacuuuuccgggugagcagcuccucuucuucagaucuaccaugcccggaugcagcggguaccccaacauggauuuggacugucugcucccccaggaaugggugcaguauuucuaccaggaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacucgcccccaugggaaaugggacggggcguagacgugcauuauaa

SEQ ID NO: 4879 - RNA, 1608 nt, Artificial Sequence
  VP1__Norovirus__ACX31893
augaagauggcgucgaaugacgccgcuccaucuaaugauggugcagccggucucguaccagaggucaacaaugagaccauggcacuugaaccgguggcuggggcuucaauagccgccccacucaccggucaaaauaauguuauagaccccuggauuagauuaaacuuugugcaggcucccaauggagaguuuacaguuucaccccgcaauucgccuggggaaguccuacuaaacuuggaauuaggcccugaacuaaauccauauuuggcacaccuuuccagaauguacaaugguuaugcagguggaguugaggugcaaguacuacuggcugggaacgcguucacggcuggaaaacugguauucgccgcaguucccccucauuuuccauuagaaaacauaagcccuggccaaauaaccauguucccucauguaauuauugauguuaggacuuuagaaccaguccuauugccucuuccagauguuaggaacaauuucuuucacuacaaucagcaaaacgaacagaggaugaggcuuguggcaaugcucuauaccccccuuagaucuaaugguucuggugaugauguauuuacugucuccuguagagugcuuacucgacccucuccugauuuugauuucaauuauuugguacccccuacaguugaaucuaaaacuaaacccuucacacucccuaucuugaccauaggggaguuaaccaauuccagauucccugugccuauagaugaacucuacacuagccccaaugagaguuuggugguacaaccccagaacgggagaugcgcgcuggauggggaguugcaggguacuacucagcuccuccccacggcgaucugcucguucaggggucggauuaaucagaaagugaguggagagaaccauguuuggaauaugcaagucaccaacauuaacggaaccccuuuugauccaacagaggauguuccagcuccucuagguacaccagacuuuucuggcaagcucuuuggcguccuaagccagagggaccaugauaaugccuguaggagccaugaugcagugauugcaacuaauucugcuaaauuuaccccaaaauugggcgcuauacaaauuggcacaugggaacaagaugauguacacaucaaccaacccaccaaauuuacuccaguuggcuuguuugaaagugaagguuuuaaucaguggacacucccuaauuauucuggagccuuaacacucaacaugggguuggcccccccuguggcccccacauuuccuggcgagcaaauucuuuucuucagaucccacauuccucuuaaaggagguguggcagacccaguuauugauugucucuugccccaagaguggauccaacaccuuuaucaggagucagccccuucacaaacagauguagcacugaucagauucacaaauccagacacagggcguguccuauuugaagcaaaauugcacaggaguggcuacaucacaguggccaacacugguagcagaccaauuguggugccagcuaaugguuacuucagguuugacucuuggguuaaucaguuuuauucucucgcccccaugggaacugggaaugggcgcagaagggugcaguaa

SEQ ID NO: 4880 - RNA, 1749 nt, Artificial Sequence
  VP1__Norovirus__ACX69259
augaagauggcgucuaaugacgcugcacccccaucuucggauggggcagccaaccucgugccagagaucaacaaugagguuauggcuuuggaaccaguagccggcgcccaauuggcugcuccugucgccggccaguucaaugcaauugaucccuggauaagacaaaauuuuguucaagcaccugaaggugaguucacuguuuccccccggaacgcuccgggcgaaauucuacugaacuuggaauuggggccacaucucaaccccuuucugcaacaccuugcucagauguacaaugccuaugcugguggcauggaggugcaaguuguccuugcggggaacgcguucaccgcuggaaagaucauauuugcugccauacccccgcauuuuccgccugagagacucucugcagcgcaagccacacaauuuccccaugugauaguugaugugagacagcuugagcccauagucuugccucuuccggaugucaggcauaacuuguuccauuucaaucagcagaaugaugaaaggaugcaucuagucgccuuccuguacaccccccugcgagcgaauucugggaauggugaugauguauucacaguguccugccgggucuugacccgacccucccaagacuuugaguucauguucuuggucccgcccacgguugaaaagaaaacgguggcguuuucucucccccaauuggccgucggggagaugucaaauucaagguggcccgcccguaucacuggcauggucgucgauccacgacucccccagguucuacacauccaaaacggccggugcacccuagaugggacacucauggguaccacccagcucaaccccaaugacaucugcaggauucgaggcuacuucuccagcucaaggcccgaguuacugugugaaggugaggagagugaggucaacacaacgcccacugauaguggagccacaggugaccagacaccagaagugagaaccggaacacgcgcgacccaaaggugguuugccgugacagaacucaauggccaggucuaugaccccuucggugaccaaccugcgccgcucgggguuccugacuucaaggcacgcauucuuggagcgcugaugcggcuaccugggaccaauccaacguccaacucaagguuugaggaugcguggguggagaccaacaaccagaccacuuaugcaccugcgaccgggguggucgccaucacaaccaaugacaacagcuccggcaauuaugcuaaugaccagacaugugaguuugucccgcuggguauugaaaucacggacucugcccccuacaacgaguucgaucugcccagcuacgguggugcagccuccucaggcaaccguaaucuggcccccacgguugccccaacguuuccaggagaggccauccuccuguuuggcucaaacaugccagucuauaacaggagcucaggcaccgacaacaaggacauacguugccucuugccuaaugaauauguacaacaccuguaugacacccaggcucccagucugagcgacguugcccuggucagguaugucaaccgugacacugggcgcgucuuguuugaggccaagcuacaccgcgacggcuucaugacagugaacgcguccuccaccacgguucuaccuguggacggguauuuccgcuuugauucuugggucaaccaguucuaugcacucagccccgugggaaacgccucaggcaggcgagggcgcagcaggcaggcuaauuaa

SEQ ID NO: 4881 - RNA, 1647 nt, Artificial Sequence
  VP1__Norovirus__ADF47131
augaagauggcgucgaaugacgccgcuccaucuaacgauggugccgccggccucgucccagagaucaacaaugaggcaauggcgcuagaaccaguggcgggugcagcgauagcagcaccccucacuggccagcaaaauauaauugaucccuggauuaugaauaauuuugugcaagcaccugguggugaguuuacagugucuccuaggaauuccccuggugaagugcuucucaauuuggaauugggcccagaaauaaaucccuauuuggcccaucuugcuagaauguauaaugguuaugcagguggguuugaagugcagguaguccuagcuggaaaugcguuuacagcaggaaagauaauuuuugcagcuauacccccuaacuucccaauugacaaucuaagcgcagcacagaucacaaugugcccacaugugauuguggaugucagacaguuggaaccggucaaccuuccgaugccugacguucgcaauaacuucuuccauuacaaccaagggucugauucgagauugcgcuuaguugcaaugcuguauacaccucuuagggcaaauaauucuggggaugauguuuuuacugugucuuguagagugcugacuaggccuagcccugacuuuucauuuaacuuccuugugccacccacuguggagucaaagacaaaacccuucacccucccuauuuugacuaucucugaaaugucuaauucuagguuuccagugccgauugauucucugcacaccagcccaacugagaauauuguuguccagugccaaaaugggcgcgucacucuugauggugaguugaugggcaccacccaacucuuaccuagucaaaucugugcuuuuaggggcgugcucaccagaucaacaagcagggccagugaccaggccgacacagcaaccccuagauuguuuaauuauuauuggcacauacaauuggauaaucuaaaugggacuccuuaugauccugcagaagacauaccaggcccccuggggacaccagacuuccggggcaaagucuuuggcguggccagccagagaaaucccgacaguacaacuagagcacaugaagcgaagguggacacaacagcuggucgcuuuaccccaaaacuaggcucauuggagauauccacugaaucuggugacuuuaaucaaaaccaaccaacaagauucaccccaguuggcauugggguugaccacgaggaagacuuccaacaaugguccuuacccgacuauucuggucaguucacucacaacaugaacuuagccccagcuguugcucccaacuucccuggugagcagcuccuuuucuuccgcucacaguuaccaucuucuggugggcgauccaaugggauucuagacugccuggucccccaagaauggguucagcacuucuaccaagaaucggcccccacccaaacccagguggcccugguuagauaugucaacccugacacugguagaguguuguuugaggccaagcugcacaaauuagguuucaugacuauagcuaagaauggugacucuccaauaacuguccccccaaauggauacuuuagguuugaaucuugggugaacccauuuuauacacuugcccccacgggaacugagaaugggcguagaaggguucaauaa

SEQ ID NO: 4882 - RNA, 1623 nt, Artificial Sequence
  VP1__Norovirus__ADR78869
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 4883 - RNA, 1623 nt, Artificial Sequence
  VP1__Norovirus__ADR78872
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauuucagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucacccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 4884 - RNA, 1623 nt, Artificial Sequence; identical to SEQ ID NO: 4882
  VP1__Norovirus__ADR78875

SEQ ID NO: 4885 - RNA, 1623 nt, Artificial Sequence
  VP1__Norovirus__ADR78878
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagcccccgcuguagcccccacuuucccgggugagcaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 4886 - RNA, 1623 nt, Artificial Sequence
  VP1__Norovirus__ADR78881
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggucauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagcccccgcuguagcccccacuuucccgggugagcaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 4887 - RNA, 1623 nt, Artificial Sequence
  VP1__Norovirus__ADR78884
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagcccccgcuguagcccccacuuuuccgggugagcaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 4888 - RNA, 1623 nt, Artificial Sequence
  VP1__Norovirus__ADR78887
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggcgguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaguuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuugguuaucccccccaauggcuauuuuagguuugauuccuggguuaaucaauucuacacacuugcccccaugggaaauggaacggggcguagacgugcuuuauaa

SEQ ID NO: 4889 - RNA, 1623 nt, Artificial Sequence
  VP1__Norovirus__ADR78890
augaagauggcgucgaaugacgccaacccaucugauggguccgcagccaaccucgucccagaggucaacaaugagguuauggcuuuggagccuguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggcgguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuugguuaucccccccaauggcuauuuuagguuugauuccuggguuaaucaauucuauacacuugcccccaugggaaauggaacggggcguagacgugcuuuauaa

SEQ ID NO: 4890 - RNA, 1623 nt, Artificial Sequence; identical to SEQ ID NO: 4882
  VP1__Norovirus__ADR78893

SEQ ID NO: 4891 - RNA, 1623 nt, Artificial Sequence; identical to SEQ ID NO: 4882
  VP1__Norovirus__ADR78896

SEQ ID NO: 4892 - RNA, 1623 nt, Artificial Sequence
  VP1__Norovirus__ADR78899
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggagcuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 4893 - RNA, 1623 nt, Artificial Sequence
  VP1__Norovirus__ADR78902
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgccuuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 4894 - RNA, 1623 nt, Artificial Sequence
  VP1__Norovirus__ADR78905
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauauuauggagcgcgccuuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 4895 - RNA, 1623 nt, Artificial Sequence
  VP1__Norovirus__ADR78908
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguuuacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuuuuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 4896 - RNA, 1623 nt, Artificial Sequence
  VP1__Norovirus__ADR78911
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugaucccccugccugauguuaggaauaauuucuaucauuacaaucaaucaaaugaccccaccaucaaauugauagcaaugcuguauacaccacuuagggcuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagauucccuauuccuuuggaaaaguuguucacgggucccagcagugccuuuguuguucaaccacaaaauggcagaugcacgacugauggcgugcuuuuagguacuacccagcugucuccugucaacaucugcaccuucagaggggaugucacccacauugcagguacucaaaauuacacaaugaaucuggccucccaaaauuggaacaauuaugacccaacagaagaaaucccagcuccucugggaaccccagauuuuguaggaaagauccaaggcgugcucacccaaaccacaaggagggacggcucgacccgcggucacaaagccacaguaagcacuggaaguguccacuucaccccaaagcugggcaguguccaacucucuacugauacaagcaaugacuuugaaacuggccaaaacacgagauucaccccagucggugucguccaggaugguaguaccacccaccaaaaugaaccccaacaaugggugcucccagacuauucagguagagauagucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguuuuguuugagugcaagcuucauaaaucaggcuauguaacaguggcucacacuggccaacaugauuugguuaucccccccaauggcuauuuuagauuugauuccugggucaaccaauucuacacacuugcccccaugggaaauggagcggggcguagacgugcauuauaa

SEQ ID NO: 4897 - RNA, 1623 nt, Artificial Sequence
  VP1__Norovirus__ADR78914
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuagacaacuggaaccuguguugaucccccugccugauguuaggaauaauuucuaucauuacaaucaaucaaaugaccccaccaucaaauugauagcaaugcuguauacaccacuuagggcuaacaaugcuggggacgaugucuucacagucucuugucgaguucucacgaggccaucccccgauuuugauuucauauuuuuggugccacccacaguugagucaagaacuaaaccauucucugucccaaucuuaacuguugaggagaugaccaauucaagauucccuauuccuuuggaaaaguuguucacgggucccagcagugccuuuguuguucaaccacaaaauggcagaugcacgacugauggcgugcuuuuagguacuacccaacugucuccugucaacaucugcaccuucagaggggaugucacccacauugcagguacucaaaauuacacaaugaaucuggccucccaaaauuggaacaauuaugacccaacagaagaaaucccagcuccucugggaaccccagauuuuguaggaaagauccaaggcgugcucacccaaaccacaaggagggacggcucgacccgcggucacaaagccacaguaagcacuggaaguguccacuucaccccaaagcugggcaguguccaauucucuacugauacaagcaaugacuuugaaacuggccaaaacacgagauucaccccagucggugucguccaggaugguaguaccacccaccaaaaugaaccccaacaaugggugcucccagacuauucagguagagauagucacaauguacaccuagccccugccguggcccccacuuuuccgggcgagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguuuuguuugagugcaagcuucauaaaucaggcuauguaacaguggcucacacuggccaacaugauuugguuaucccccccaauggcuauuuuagauuugauuccugggucaaccaauucuacacacuugcccccaugggaaauggagcggggcguagacgugcauuauaa

SEQ ID NO: 4898 - RNA, 1623 nt, Artificial Sequence
  VP1__Norovirus__ADR78917
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccgggaaaauaauauuugcagcagucccaccaaauuucccaacugaaggcuugagccccagccaggucacuauguucccccauauaauaguagauguuaggcaacuggaaccuguguugaucccccugccugauguuaggaauaauuucuaccauuacaaucaaucaaaugaccccaccaucaaauugauagcaaugcuguauacaccacuuagggcuaauaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagguucccuauuccuuuggaaaaguuguucacgggucccagcagugccuuuguuguucaaccacaaaauggcagaugcacgacugauggcgugcuuuuagguacuacccaacugucuccugucaacaucugcaccuucagaggggaugucacccacauugcagguacucaaaauuacacaaugaaucuggccucccaaaauuggaacaauuaugacccaacagaagaaaucccagcuccucugggaaccccagauuuuguaggaaggauccaaggcgugcucacccaaaccacaaggagggacggcucgacccgcggucacaaagccacaguaagcacuggaaguguccacuucaccccaaagcugggcaguguucaauucucuacugauacaagcaaugacuuugaaacuggccaaaacacgagauucaccccagucggugucguccaggaugguaguaccacccaccaaaaugaaccccaacaaugggugcucccagacuauucagguagagauagucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguucuguuugagugcaagcuucauaaaucaggcuauguaacaguggcucacacuggccaacaugauuugguuaucccccccaauggcuauuuuagauuugauuccugggucaaccaauucuacacacuugcccccaugggaaauggagcggggcguagacgugcauuauaa

SEQ ID NO: 4899 - RNA, 1623 nt, Artificial Sequence
  VP1__Norovirus__ADR78920
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuaggaauaauuuuguacaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugaucccccugccugauguuaggaauaauuucuaucauuacaaucaaucaaaugacccuaccaucaaauugauagcaauguuguauacaccacuuagggcuaacaaugcuggggacgaugucuuuacagucucuugucgaguucucacgagaccaucccccgauuuugauuucauauuuuuggugccacccacaguugagucaagaacuaaaccauucucugucccaaucuuaacuguugaggagaugaccaauucaagauucccuauuccuuuggaaaaguuguucacgggucccagcagugccuuuguuguucaaccacaaaauggcagaugcacgacugauggcgugcuuuuaggcacuacccaauugucuccugucaacaucugcaccuucagaggggaugucacccacauugcagguacucaaaauuacacaaugaaucuggccucccaaaauuggaacaauuaugacccaacagaagaaaucccagcuccucugggaaccccagauuuuguaggaaagauccaaggcgugcucacccaaaccacaaggagggacggcucgacccgcggucacaaagccacaguaagcacuggaaguguccacuucaccccaaagcugggcaguguucaauucucuacugauacaagcaaugacuuugaaacuggccaaaacacgagauucaccccagucggugucguccaggauggugacaccacccaccaaaaugaaccccaacaaugggugcucccagacuauucagguagagauagucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguuuuguuugagugcaagcuucauaaaucaggcuauguaacaguggcucacacuggccaacaugauuugguuaucccccccaauggcuauuuuagauuugauuccugggucaaccaauucuacacacuugcccccaugggaaauggagcggggcguagacgugcauuauaa

SEQ ID NO: 4900 - RNA, 1623 nt, Artificial Sequence
  VP1__Norovirus__ADR78923
augaagauggcgucgaaugacgccaccccaucugauggguccacagccaaccucgucccagaggucaacaaugagguuauggcuuuggagcccguuguuggugccgcgauugcggcgccuguagcgggccaacaaaauguaauugaccccuggauuagaaauaauuuuguacaagccccuggcggagaguucacaguguccccuagaaacgcuccaggugaaauauuauggagcgcgcccuugggcccugauuugaaucccuaccuuucccauuuggccagaauguacaaugguuaugcaggugguuuugaagugcaggugauccucgcggggaacgcguucaccgccgggaaaaucaucuuugcagcagucccaccaaauuucccaacugaaggcuugagccccagccaggucacuauguucccccauauaauaguagauguuaggcaacuggaaccuguguuaaucccccugccugauguuaggaauaauuucuaucacuacaaucaaucaaaugacuccaccaucaaauugauagcaaugcuguauacaccacuuagggcuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagauuccccauuccuuuggaaaaguuguucacgggucccagcagugccuuuguuguucaaccacaaaauggcagaugcacgacugauggcgugcuucuagguacuacccaacugucuccugucaacaucugcaccuucagaggggaugucacccacauugcagguacucaaaauuacacaaugaaucuggccucccaaaauuggaacaauuaugacccaacagaagaaaucccagcuccucugggaaccccagauuuuguaggaaagauccaaggcgugcucacccaaaccacaaggagggacggcucgacccgcggucacaaagccacaguaagcacuggaaguguccacuucaccccaaagcugggcaguguccaauucucuacugauacaaguaaugacuuugaaacuggccaaaacacgagauucaccccagucggugucguccaggaugguaguaccacccaccaaaaugaaccccaacaaugggugcucccagacuauucagguagagauagucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguuuuguuugagugcaagcuucauaaaucaggcuauguaacaguggcucacacuggccaacaugauuugguuaucccccccaauggcuauuuuagauuugauuccugggucaaccaauucuacacacuugcccccaugggaaauggagcggggcguagacgugcauuauaa

SEQ ID NO: 4901 - RNA, 1623 nt, Artificial Sequence
  VP1__Norovirus__ADR78929
augaagauggcgucgaaugacgccagcccaucugauggguccacagccaaucucgucccagaggucaacaaugagguuauggcuuuggagcccguuguuggugccgcuauugcggcaccuguagcgggccaacaaaauguaauugaccccuggauuaggaauaauuuuguacaagccccugguggagaguucacaguauccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaauuggaaccuguguugauccccuuaccugauguuaggaauaauuucuaucauuacaaucaaucaaaugacuccaccauuaaauugauagcaaugcuguacacaccacuuagggcuaauaaugcuggggaugacgucuucacagucucuugucgaguccucacgaggccaucccccgauuuugauuucauauuucuggugccacccacaguugagucaagaaccaaaccauucaccgucccaaucuuaacuguugaggaaaugaccaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggcgaugucacccacauuucaggcacucguacuuacaggaugaauuuggcuucucaaaauuggaacaauuaugacccaacagaagaaaucccagccccucugggaaccccagauuucgugggaaagauccaaggcaugcucacccaaaccacaaagggagacggcucgacccgcggucacaaagcuacagugagcacugggaguguugacuuuacuccaaagcugggcagcguucaguucgccacugauacagacaaugauuuugaaacuggccaaaacacaagguucaccccagucggugucauccaggaugguaguagugcccacagaaaugaaccccaacaauggguacucccagauuacucagguagaacuguucauaauguacaccuagccccugccguagcccccacuuuuccgggugagcaacuucuuuucuucagaucuacuaugcccggaugcaguggguaucccaauauggauuuggauugucuacucccccaggaaugggugcagcacuucuaccaagaggcagccccaucacaaucugauguggcuuugcugagauuugugaauccagacacagguaggguucuguuugagugcaagcuucauaaagcaggcuaugucacaguggcucauacuggccagcaugauuugguuaucccccccaaugguuacuuuagauuugauuccugggucaaccaguucuacacacuugcccccaugggaaauggagcggggcguagacgugcauuauaa

SEQ ID NO: 4902 - RNA, 1623 nt, Artificial Sequence
  VP1__Norovirus__ADR78932
augaagauggcgucgagugacgccagcccaucugauggguccgcagccaaccucgucccagaggucaacaaugagguuauggcuuuggagcccguuguuggugccgcuauugcggcaccuguagcgggccaacaaaauguaauugaccccuggauuaggaauaauuuuguacaagccccugguggagaguucacaguauccccuagaaacgcuccaggugaaauacuauggagcgcgcccuuaggcccugaucugaacccauaccuuucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaauuggaaccuguguugauccccuuaccugauguuaggaauaauuucuaccauuacaaucaaucaaaugacuccaccauuaaauugauagcaaugcuguacacaccacuuagggcuaauaaugcuggggaugaugucuucacagucucuugucgaguccucacgaggccaucccccgauuuugauuucauauuucuggugccacccacuguugagucaagaaccaaaccauucaccgucccaauuuuaacuguugaggaaaugaccaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggcgaugucacccacauuucagguucucguaauuacagaaugaauuuggcuucucaaaauuggaacaauuaugacccaacagaagaaaucccagccccucugggaacuccagauuucgugggaaagauccaaggcaugcucacccaaaccacaaagggagacggcucgacccgcggucacaaagcuacagugagcacugggaguguugacuuuacuccaaagcugggcagcguucaguucgccacugauacagacaaugauuuugaaacuggccaaaacacaagguucaccccagucgguguuauccaggaugguaguagugcccacagaaaugaaccccaacaauggguacucccagauuacucaggcagaacuguucauaauguacaccuagccccugcuguagcccccacuuuuccgggugagcaacuucuuuucuucagaucuacuaugcccggauguaguggguaucccaauauggauuuggauugucuacucccccaggaaugggugcagcacuucuaccaagaggcagccccaucacaaucugauguggcuuugcugagauuugugaauccagacacagguaggguucuguuugagugcaagcuucauaaagcaggcuaugucacaguggcucacacuggccagcaugauuugguuaucccccccaauggcuacuuuagauuugauuccugggucaaccaguucuacacacuugcccccaugggaaauggagcggggcguagacgugcauuauaa

SEQ ID NO: 4903 - RNA, 1623 nt, Artificial Sequence
  VP1__Norovirus__ADR78938
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuaggaauaauuuuguacaagcuccugguggagaguucacaguauccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccacauaauaguagauguuaggcaauuggaaccuguguugauccccuuacccgauguuaggaauaauuucuaccauuacaaucaaucaaaugacuccaccauuaaauugauagcaaugcuguacacaccacuuagggcuaauaaugcuggggaugaugucuucacagucucuugucgaguccucacgaggccaucccccgauuuugauuucauauuucuggugccacccacaguugagucaagaaccaaaccauucaccgucccaauuuuaacuguugaggaaaugaccaauucaagauuccccauuccuuuggaaaaauuguucacgggucccagcagugccuuugucguccaaccacaaaauggcaggugcacgacugauggcgugcucuuaggcacuacccaauugucccccgucaacaucugcaccuucagaggcgaugucacccacauuccagguacccguucuuacagaaugaauuuggcuucucaaaauuggaacaauuaugacccaacagaagaaaucccagccccucugggaacuccagauuucgugggaaagauccaaggcaugcucacccaaaccacaaagagagacggcucgacccgcggucacaaagcuacagugagcacugggaguguugacuuuacuccaaagcugggcagcguucaguucgccacugauacagacaaugauuuugaaacuggccaaaacacaagguucaccccagucggugucauucaggaugguaguaguacccacagaaaugaaccccaacaauggguacucccagauuauucagguagaacuguucauaauguacaccuggccccugccguagcccccacuuuuccgggugagcaacuucuuuucuucagaucuacuaugcccggaugcaguggguaucccaauauggauuuggauugucuacucccccaggaaugggugcagcacuucuaccaagaggcagccccaucacaaucugauguggcuuuguugagauucgugaauccagacacagguaggguucuguuugagugcaagcuucauaaagcaggcuaugucacaguggcucacacuggccagcaugauuugguuaucccccccaauggcuacuuuagauuugauuccugggucaaccaguucuacacacuugcccccaugggaaauggagcggggcguagacgugcauuauaa

SEQ ID NO: 4904 - RNA, 1623 nt, Artificial Sequence
  VP1__Norovirus__ADR78941
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuaggaauaauuuuguacaagccccugguggagaguucacaguauccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccacauaauaguagauguuaggcaauuggaaccuguguugauccccuuaccugauguuaggaauaauuucuaccauuacaaucaaucaaaugacuccaccauuaaauugauagcaaugcuguacacaccacuuagggcuaauaaugcuggggaugaugucuucacagucucuugucgaguccucacgaggccaucccccgauuuugacuucauauuucuggugccacccacaguugagucaagaacuaaaccauucaccgucccaauuuuaacuguugaggaaaugaccaauucaagauuccccauuccucuggaaaaauuguucacgggucccagcagugccuuugucguccaaccacaaaauggcaggugcacgacugauggcgugcucuuaggcaccacccaacugucccccgucaacaucugcaccuucagaggcgaugucacccacauuccagguacucguacuuacagaaugaauuuggcuucucaaaauuggaacaauuaugacccaacagaagaaaucccagccccucugggaacuccagauuucgugggaaagauccaaggcaugcucacccaaaccacaaagggagacggcucgacccgcggucauaaagcuacagugagcacugggaguguugacuuuacuccaaagcugggcagcguucaguucgccacugauacagacaaugauuuugaaacuggccaaaacacaagguucaccccagucggugucauccaggaugguaguaguacccacagaaaugaaccccaacaauggguacucccagauuacucagguagaacuguucauaauguacaccuggccccugccguagcccccacuuuuccgggugagcaacuucuuuucuucagaucuacuaugcccggaugcaguggguaucccaauauggauuuggauugucuacucccccaggaaugggugcagcacuucuaccaagaggcagccccaucacaaucugauguggcuuuguugagauuugugaauccagacacagguaggguucuguuugagugcaagcuucauaaagcaggcuaugucacaguggcucacacuggccagcaugauuugguuaucccccccaauggcuacuuuagauuugauuccugggucaaccaguucuacacacuugcccccaugggaaauggagcggggcguagacgugcauuauaa

SEQ ID NO: 4905 - RNA, 1623 nt, Artificial Sequence
  VP1__Norovirus__ADR78944
augaagauggcgucgaaugacgccagcccaucugauggguccacagccaaccucgucccagaggucaacaaugagguuauggcuuuggagcccguuguuggugccgcuauugcggcaccuguggcgggccaacaaaauguaauugaccccuggauuaggaauaauuuuguacaagccccugguggagaguucacaguguccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccacauaauaguagauguuaggcaauuggaaccuguguugauccccuuaccugauguuaggaauaauuucuaccauuauaaucaaucaaaugacuccaccauuaaauugauagcaaugcuguacacaccacuuagggcuaauaaugcuggggaugaugucuucacagucucuugucgaguccucacgaggccaucccccgauuuugauuucauauuucuggugccacccacaguugagucaagaaccaaaccauucaccgucccaauuuuaacuguugaggaaaugaccaauucaagauuccccauuccuuuggaaaaauuguucacgggucccagcagugccuuugucguccaaccacaaaauggcaggugcacgacugauggcgugcucuuaggcaccacccaacugucccccgucaacaucugcaccuucagaggcgaugucacccacauuucagguucucguacuuacagaaugaauuuggcuucucaaaauuggaacaauuaugacccaacagaagaaaucccagccccucugggaacuccagauuucgugggaaagauccaaggcaugcucacccaaaccacaaagggagacggcucgacccgcggucacaaagcuacagugagcacugggaguguugacuuuacuccaaagcugggcagcguucaguucgccacugauacagacaaugauuuugaaacuggucaaaacacaagguucaccccaguuggugucauccaggaugguaguaguacccacagaaaugaaccccaacaauggguacuuccagauuacucagguagaacuguucauaauguacaccuggccccugccguagcccccacuuuuccgggugagcaacuucuuuucuucagaucuacuaugcccggaugcaguggguaucccaauauggauuuggauugucuacucccccaggaaugggugcagcacuucuaccaagaggcagccccaucacaaucugauguggcuuuguugagauuugugaacccagacacagguaggguucuguuugagugcaagcuucauaaagcaggcuaugucacaguggcucacacuggccagcaugauuugguuaucccccccaauggcuacuuuagauuugauuccugggucaaccaguucuacacacuugcccccaugggaaauggagcggggcguagacgugcauuauaa

SEQ ID NO: 4906 - RNA, 1623 nt, Artificial Sequence
  VP1__Norovirus__ADR78947
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuaggaauaauuuuguacaagccccugguggagaguuuacaguauccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccacauaauaguagauguuaggcaauuggaaccuguguugauccccuuaccugauguuaggaauaauuucuaucauuauaaucaaucaaaugacuccaccauuaaauugauagcaaugcuguacacaccacuuagggcuaauaaugcuggggaugaugucuucacagucucuugucgaguccucacgaggccaucccccgauuucgauuucauauuucuggugccacccacaguugagucaagaaccaaaccauucaccgucccaauuuuaacuguugaggaaaugaccaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggcgaugucacccacauuccaggcacucguacuuacagaaugaauuuggcuucucaaaauuggaacaauuaugacccaacagaagaaaucccagccccccugggaacuccagauuucgugggaaagauccagggcaugcucacccaaaccacaaagggagacggcucgacccgcggucacaaagcuacagugagcacugggaguguugacuuuacuccaaagcugggcagcguucaguucgccacugauacagacaaugauuuugaaacuggccaaaacacaagguucaccccagucggugucauccaggaugguaguaguacccacagaaaugaaccccaacaauggguacucccagauuacucagguagaacuguccauaauguacaccuggccccugccguagcccccacuuuuccgggugagcaacuucuuuucuucagaucuacuaugcccggaugcaguggguaucccaauauggauuuggauugucuacucccccaggaaugggugcagcacuucuaccaagaggcagccccgucacaaucugauguggcuuuguugagauuugugaauccagacacagguaggguucuguuugagugcaagcuucauaaagcaggcuaugucacaguugcucacacuggccagcaugauuuggucaucccccccaauggcuacuuuagauuugauuccugggucaaccaguucuacacacuugcccccaugggaaauggagcggggcguagacgugcauuauaa

SEQ ID NO: 4907 - RNA, 1623 nt, Artificial Sequence
  VP1__Norovirus__ADR78950
augaagauggcgucgaaugacgccagcccaucugauggguccgcagccaaccucgucccagaggucaacaaugagguuauggcuuuggagcccguuguuggugccgcuauugcggcaccuguggcgggccaacaaaauguaauugaccccuggauuaggaauaauuuuguacaagccccugguggagaguucacaguguccccuagaaacgcuccaggugaaauacuauggagcgcgcccuuagguccugaucugaacccauaccuuucucaccuggccagaauguacaaugguuaugcaggugguuuugaagugcagguacuccucgcggggaacgcguucaccgccgggaaaaucauauuugcagcagucccaccaacuuuuccaacugaaggcuugagccccagccaggucacuauguucccccacauaauaguagauguuaggcaauuggaaccuguguugauccccuuaccugauguuaggaauaauuucuaccauuacaaucaaucaaaugacuccaccauuaaauugguagcaaugcuguacacaccacuuagggcuaauaaugcuggggaugaugucuucacagucucuugucgaguccucacgaggccaucccccgauuuugauuuuauauuucuggugccacccacaguugagucaagaaccaaaccauucaccgucccaauuuuaacuguugaggaaaugaccaauucaagauuccccauuccuuuggaaagauuguucacgggucccagcagugccuuuguuguccaaccacaaaauggcaggugcacgacugacggcgugcucuuaggcacuacccaacugucccccgucaacaucugcaccuucagaggcgaugucaccaacauuccagguucucguacuuacagaaugaauuuggcuucucaaaauuggaacaauuaugacccaacggaagaaaucccagccccucugggaacuccagauuucgugggaaagauccaaggcgugcucacccaaaccacaaagggagacggcucgacccgcggucacaaagcuacagugagaacugggagugcugauuuuacuccaaagcugggcagcguucaguucgccacugauacagacaaugauuuuguaaccggccaaaacacaagguucaccccagucggugucauccaugaugguaguagugcccacagaaaugaaccccaacaauggguacucccagaauacucagguagaucuguucauaauguacaccuagccccugccguagcccccacuuuuccgggugagcaacuucuuuucuucagaucuacuaugcccggaugcaguggguaucccaauauggauuuggauugucuacucccccaggaaugggugcagcacuucuaccaagaggcagccccgucacaaucugauguggcuuugcugagauuugugaauccggacacagguaggguucuguuugagugcaagcuucauaaagcaggcuaugucacaguggcucacacuggccagcaugauuugguuaucccucccaauggcuacuuuagauuugauuccugggucaaccaguucuacacacuugcccccaugggaaauggagcggggcguagacgugcauuauaa

SEQ ID NO: 4908 - RNA, 1623 nt, Artificial Sequence
  VP1__Norovirus__ADR78956
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguucacaguauccccuagaaacgcuccaggugaaauauuauggagcgcgcccuuaggcccugaucugaauccauaccuuucucaccuggccagaauguacaaugguuaugcaggugguuuugaagugcagguaauccucgcggggaacgcguucaccgcugggaaaaucauauuugcagcagucccaccaaauuucccaacugaaggcuugagccccagccaggucacuauguucccccauauaauaguagauguuaggcaauuggaaccuguguugauccccuuaccugauguuaggaauaauuucuaccacuauaaucaaucaaaugacuccaccauuaaauugauagcaaugcuguacacgccacuuagggcuaauaaugcuggggaugaugucuucacagucucuugucgaguccucacgagaccaucccccgauuuugauuucauauuucuggugccacccacaguugagucaagaaccaaaccauucaccgucccaauuuuaacuguugaggaaaugacuaauucaagauuccccauuccuuuggaaaaauuguucacgggucccagcagugccuuugucguccaaccacaaaaugguaggugcacgacugauggcgugcucuuaggcacuacccaacugucccccgucaacaucugcaccuucagaggggaugucacccacauuccagguacucguacuuacagaaugaauuuggcuucucaaaauuggaacaauuaugacccaacagaagaaaucccagccccucugggaacuccagauuucgugggaaagauccaaggcaugcucacccaaaccacaaagggagacggcucgacccgcggucacaaagcuacagugagcacugggagugucgacuuuacuccaaagcugggcagcguucaguucgccacugauacagacaaugauuuugaaacuggccaaaacacaagguucaccccaguuggugucauccaggaugguaguagugcccacagaaaugaaccccaacaauggguacucccagauuacucagguagaacuguucauaauguacaccuagccccugccguagcccccacuuuuccgggugagcaacuucuuuucuucagaucuacuaugcccggaugcaguggguaucccaauauggauuuggauugucuacucccccaggaaugggugcagcacuucuaccaagaggcagcuccagcacagucugauguggcuuugcugagauuugugaauccagacacagguaggguuuuguuugagugcaagcuucauaaaacaggcuaugucacaguggcucacacuggccagcaugauuugguuaucccccccaauggcuauuuuagauuugauuccugggucaaccaguucuacacacuugcccccaugggaaauggagcggggcguagacgugcauuauaa

SEQ ID NO: 4909 - RNA, 1653 nt, Artificial Sequence
  VP1__Norovirus__AEA02124
augaugauggcgucuaaggacgcuaccucaaacauggauggcaccagcggagcuggacaacuggugccagagaauaacaacaccucagaaccaaucaauauggaaccagucgcgggcgcggucacugccgcagcuacggcuggccaggugaauaugauugauccuuggauaaugaauaauuaugugcaagccccccagggugaguucacaaucucacccaauaacaccccuggugauauauuguuugaucuucaauuggguccccaucuuaaccccuuucuugcucauuuaucccaaauguauaauggauggguugguaacaugaaagucagaguggugcuggcuggcaaugccuucucugcgggaaagauuauagugugcuguauaccaccuggauuuucugcaccaaacauaucuauagcccaggcaacuauguucccacauguuauugcugauguucgggucuuggagcccauugauaucccccuugaugaugucaggaauguuuuguuucauacuaaugauaaugguaaucagaccaugagauuguugugcauguuauacacaccacuucguaguggggguacauccagugggacugacccauuuguaauugcugguaggguccuaaccuguccuacuccagauuuuaauuuucuguuuuuaguucccccaaccguugagcagaagaccaaacaguuuaguguaccgaaccucccccucaauguuaugucuaacucuagaguuccaucacugcugaaugccaugguugugucaccagaucaggcccaaguggugcaauuucagaaugguaggugcacccuugaugggcaaauguuaggcaccacuacuguaucagcuaguuguguugcaagauucagagggaaaacuuuucaagccccugacaacagguuagguauuaaucuggcugaaauuaguggagaaccauaucaugcauucgaaagccccgccccccuagguuuccccgauuuuggggauggagauuggcaugucacugcaacaaaaguaacccccucacagcuugaagcuaaugauccuguggucguggggaauguccaaccauacaauccacaguuugccccucaccugggcacccuaguuguagaaaaccccaccccagaccaaguggccaccgggacugaucuauuauucaacauaaccuggcuuuccaaucgugccaacaaucgguuuaacccuugggucauuccaaauuaugguucaacucucacggaggcggcacagcuggcaccuucaauauuuccccccggcuuuggugaaacuauaguguauuuuaauuccacuuuuccagcagugggugccaccacccaugcagcuauacccuguuugcuuccacaagaauuuguugcucauuuuguuaaugagcaggcccccauacguggagaggcugcucugcuccacuauauugacccugacacucaccguaaucuuggugaguucaaaauuuauccugagggcuuugugacgugugucccuaauguggguggcacagggccacaaucucuaccuacuaauggugucuuugucuuuguuucuugggugucaagguauuaucaacucaagccugugggaacugcuggucaagcaagacggcuugguuucaggagaguauaa

SEQ ID NO: 4910 - RNA, 1647 nt, Artificial Sequence
  VP1__Norovirus__AED02033
augaagauggcgucgaaugacgcugcuccaucuaaugauggugccgccggccucgucccagagaucaacaaugaggcaauggcgcuagagccaguggcgggugcagcgauagcagcgccccucacuggccagcaaaauauaauugaucccuggauuaugaauaauuuugugcaagcaccugguggugaguuuacagugucaccuaggaauuccccuggugaagugcuucuuaauuuggaauuagguccagaaauaaaucccuauuuggcucaucuugcuagaauguacaaugguuaugcagguggauuugaagugcaagugguccuagcuggaaaugcguuuacagcaggaaagguuaucuuugcagcuauacccccuaauuucccuauugacaaucugagcgcggcacagaucacaaugugcccgcacgugauuguggaugucaggcaguuggaaccaaucaaucucccgaugccugauguccgcaacaauuucuuucauuauaaucaagguucugauucaagauuacguuugauugcaaugcuguauacaccucuuagggcaaauaauucuggagaugauguuuucacugugucuuguaggguguuaacuaggccuagcccugauuucucauucaauuuucuugucccacccacuguggaaucaaagacaaaaccuuuuacccuccccauuuuaaccaucucugaaaugucuaauuccagguuuccggugccaauugacucucugcacaccagcccaacugagaauauaguuguccagugccaaaaugggcgcgucacucuugacggugaguuaaugggcaccacccaacucuuaccgagccaaauaugugcuuucaggggcacacucauuagaucaacaagcagggccagugaccaagccgacacaucaaccccuaggcuauucaacuauuauuggcacauacaauuggauaaucuaaauggaacucccuacgacccugcagaggacauaccagcuccuuugggcacaccagacuuccggggcaaggucuuuggcguagccagccagagaaaccccgacagcacaacaagggcacaugaagcaaaaguggacacaacaucuggccgcuucaccccaaaauuggguuccuuagaaauaaucacugaaucugaugacuuugacuuaaaccagucaacaaaauucaccccaguuggcauuggaguugacaaugaggcagaauuucagcagugguccuuacccaacuauucuggucaguuuacucauaauaugaacuuagccccagcugucgcccccaacuuuccuggugaacagcuacuuuucuuccgaucacagcugccauccucuggugggcgaucuaacggggugcuagauugccuggucccccaggaauggguucaacacuuuuaccaagaaucagcccccgcccaaacacagguggcccugguuagguaugucaacccugacacuggcagagugcuauuugaggccaagcuacacaaauuggguuuuaugacuauagcaaagaauggugacuccccaauaacugucccuccaaauggauauuuuagauuugaaucuuggguuaaccccuuuuacacacuugcccccaugggaacuggaaacgggcguagaaggauucaauaa

SEQ ID NO: 4911 - RNA, 1647 nt, Artificial Sequence
  VP1__Norovirus__AED02034
augaagauggcgucgaaugacgcugcuccaucuaacgauggugccgccggccucguaccagagaucaauaaugaggcaauggcgcuagagccaguggcgggugcagcgauagcagcaccccucacuggucagcaaaauauaauagaucccuggauuaugaauaauuuugugcaagcaccugguggugaguuuacagugucaccuaggaacuccccuggugaagugcuucuuaacuuagaguuaggcccagaaauaaaccccuauuuggcacaccuugcuaggauguacaaugguuaugcagguggauuugaagugcagguuguccuggcuggaaaugcguuuacagcagggaaagugaucuuugcagcuauacccccuaauuuuccaauugauaaucugagugcagcacagauuacaauguguccacaugugauuguggacgucaggcaauuggaaccaaucaaucucccgaugccugauguccgcaacaauuucuuccauuacaaucaagggucugauucgagguuacgcuuaauugcaaugcuguacacaccucuuagggcaaauaauucuggagaugauguuuucacuguguccugcaggguguuaacuaggccuagcccugauuucucauucaauuuccuugucccgcccacuguggagucaaagacaaaacccuucacccuucccauucuaacuauuucugaaaugucuaauuccagguuuccagugccaauugacucucugcacaccagccugacugaaaauauuguuguccagugccagaaugggcgcgucacucuugacggcgagcuaaugggcaccacccaacucuugccgagucaaauaugcgcuuucaggggcacucucaccagaucaacaagcagggccagugaccaagccgacacagcaaccccuaggcuuuucaacuauuauuggcauauacaauugaauaaccuaaauggaacccccuacgacccugcagaggacauaccagccccuuuggggacgccagacuuucggggcaaggucuuuggcguagccagccagagaaacccugauagcacaacaagagcacaugaagcaaaaguggacacaacaucuggccguuucgccccaaaauugggcucccuggaaauauccacugaaaccgacgacuuuaaccaaaaccaaccaacaagauuuaccccaguuggcauugggguugauaaugaggcagauuuucaacaaugguccuugccugacuacuccggucaguucacccacaacaugaacuuggccccagcugucgcacccaacuuccccggugaacagcuucucuucuuccgcucacagcugccauccucuggugggcgguccagugggauucuagacugccuggucccccaagaauggguucaacacuucuaccaagaaucagccccugcgcaaacacagguggcucuggucagguaugucaacccugauacugguagaguguuauuugaggccaagcuacauaaauuagguuucaugaccauagcuaagaauggugacucuccaauaacugucccuccaaauggauacuuuagguuugaaucuugggugaaccccuuuuauacacuagcccccaugggaacuggaaaugggcguagaaggauucaauaa

SEQ ID NO: 4912 - RNA, 1647 nt, Artificial Sequence
  VP1__Norovirus__AED02035
augaagauggcgucgaaugacgcugcuccaucuaacgauggugccgccggccucgucccagagaucaacaaugaggcaauggcgcuagagccaguggcaggugcggcaauagcagcaccucucacuggucagcaaaauauaauugaucccuggauuaugaauaauuuugugcaagcaccugguggugaguuuacagugucaccuaggaacucuccuggugaaguacuucuuaauuuagaauuagguccagaaauaaaccccuauuuggcucaccuugccaggauguacaaugguuaugcagguggguuugaggugcagguaguccuggcuggaaaugcguuuacagcaggaaaggugaucuuugcagcuauaccccccaauuucccaauugacaauuugagcgcagcacagauuacaaugugcccgcaugugauuguggauguuagacaauuggaaccaaucaaccuuccgaugccugacguccguaacaauuucuuucauuauaaucaagggucugauucgagguugcguuuaauugcaauguuauauacaccccuuagggcaaauaauucaggagaugauguuuucacugugucuuguaggguguuaacuaggccuagcccugauuucucauucaacuuucuuguuccaccuacuguagagucaaagacaaagccuuucacccuccccauuuugaccauuuccgaaaugucuaauucuagauuuccagugccaauugauucucugcacaccagcccgacugagaacauuguuguccagugccaaaauggucgagucacccuugauggugaguuaaugggcaccacucaacuccugccgagucaaauaugugcuuucaggggcacgcucaccagaucaacaagcaggaccggugaccaagcugacacggcauccccuagauuguucaacuauuauuggcacauacaauuggauaaucuaaauggaacccccuaugacccugcagaagacauaccagcccccuugggaacaccagauuuccggggcaaggucuuuggcguagcuagccagagaaacccugacagcacaacaagagcacaugaagcaaaaguggacacaacaucuggucgcuuugccccaaaauuggguucccuagaaauauccacugaaucugaugacuuugacucaaaccaaccaacaagguuuaccccaguuggcauugggguugaccgagagacagauuuucagcaauggaccuuaccugaauacuccggucaguucacacauaacaugaaucuagccccagcugucgcccccaacuucccuggugagcagcuucuuuucuuccgcucgcaguugccaucuucuggcgggcggucuggcgggauucuggacugccugguuccccaggaauggguucaacacuucuaccaggaaucagccccugcccaaacacagguagcccuaguuagguauguuaacccugacacuggcagagugcuauuugaggccaaacuacauaaauugggcuucaugacuauagcuaaaaauggugacucuccaauaacugucccuccaaauggauacuuuagguuugaaucuugggugaaccccuuuuauacacuugcccccaugggaacuggaaaugggcguagaaggauucaauaa

SEQ ID NO: 4913 - RNA, 1647 nt, Artificial Sequence
  VP1__Norovirus__AED02037
augaagauggcgucgaaugacgcugcuccaucuaaugauggugccgccggccucgucccagagaucaacaaugaggcaauggcgcuagauccaguggcgggugcagcgauagcagcaccccucacuggccagcaaaauauaauugaucccuggauuaugaacaauuuugugcaagcaccugguggugaguuuacagugucaccuaggaauuccccuggugaagugcuucuuaauuuggaauuagguccagaaauaaaucccuauuuggcucaucuugcuagaauguauaaugguuaugcagguggguuugaagugcaagugguccuggcuggaaaugcguuuacagcaggaaaggugaucuuugcagcuauaccccccaacuucccuauugacaaucugagcgcagcacagaucacaaugugcccgcacgugauuguggaugucaggcaguuggaaccaaucaaucuuccgaugccugauguccgcaacaauuucuuucauuauaaucaagggucugauucaagauuacguuuaauugcaaugcuguauacaccucuuagggcaaauaauucuggagaugauguuuucacugugucuuguaggguguuaacuaggccuagcccugauuucucauucaauuuucuugucccacccacuguggaaucaaagacaaaaccuuuuacccuccccauuuuaaccaucucugaaaugucuaauuccagguuuccggugccaauugacucucugcacaccagcccaacugagaguaucguuguccagugucaaaaugggcgcgucacucuugacggugaguuaaugggcaccacccaacucuuaccgaaccaaauaugugcuuucaggggcacacuuacuaggucaacaaacagggccagugaucaagccgacacagcaacccccaggcuauucaaccaucauuggcacauacaauuggauaaucuaaauggaacccccuacgacccugcagaggacauaccagcuccuuugggcacaccagacuuccggggcaaagucuuuggcguagccagccagagaaaccccgacagcacaacaagggcacaugaagcaaaaguggacacaacaucuggccgcuucaccccaaaauugggcucccuagaaauaaccacugaaucugaugacuuugacccaaaccagucaacaaaauucaccccaguuggcauuggaguugacaaugaggcagauuuucagcaaugguccuuaccugacuauuccggucaguuuacucauaacaugaacuuagccccagcugucgcccccaauuuuccuggugaacagcuucuuuucuuccgaucacagcugccaucuucuggugggcggucuaacgggauucuagacugccuggucccccaggaauggguucaacacuucuaccaggaaucagcccccgcccaaacacagguggcccugguuagguaugucaacccugacacugguagagugcuauuugaggccaagcuacacaaauuggguuuuaugacuauagcaaagaauggugacuccccaauaacugucccuccaaauggguauuuuagauuugaaucuuggguuaaccccuuuuacacacuugcccccaugggaacuggaaacgggcguagaaggauucaauaa

SEQ ID NO: 4914 - RNA, 1647 nt, Artificial Sequence
  VP1__Norovirus__AED02038
augaagauggcgucgaaugacgcugcuccaucuaacgauggugccgccggccucgucccagagaucaacaaugaggcaauggcgcuagagccaguggcaggugcagcaauagcagcaccucucacuggccagcaaaacauaauugaucccuggauuaugaauaauuuugugcaagcaccugguggugaguuuacagugucaccuaggaacuccccuggugaaguacuucuuaauuuagaauuagguccagaaauaaaccccuauuuggcucaccuugcuaggauguacaaugguuaugcagguggguuugaggugcagguaguccuggcuggaaaugcguuuacagcaggaaaggugaucuuugcagcuauaccccccaauuucccaauugacaaucugagcgcagcacagauuacaaugugcccgcaugugauuguggaugucagacaauuggaaccaaucaaccuuccgaugccugauguccguaauaauuucuuucauuauaaucaagggucugauucgagguugcguuuaauugcaauguuauacacaccucuuagggcaaauaauucaggagaugauguuuucacugugucuuguaggguauuaacuaggccuagcccugauuucucauucaauuuucucguuccaccuacuguggaaucaaagacaaagccuuucacccuccccauuuugacuauuucugaaaugucuaauucuagauuuccagugccaauugacucucugcacacuagcccgacugagaacauuguuguccagugccaaaaugggcgcgucacccuugacggugaguuaaugggcaccacucaacucuugccgagucaaauaugugcuuucaggggcacgcucaccagaucaacaagcagggccggugaccaagcugacacggcaaccccuagauuguucaauuauuauuggcacauacaauuggauaaccuaaauggaacccccuaugacccugcagaagacauaccagccccuuugggaacaccagacuuccggggcaaggucuuuggcguagcuagccagagaaacccugacagcacaacaagagcacaugaagcaaaaguggacacaacaucuggucgcuucgccccgaaauuggguucccuagaaauauccacugaauccagugacuuugacucaaaccaaccaacaagguucaccccaguuggcauugggguugacaaugaggcagauuuucagcaaugguccuuaccugacuacuccggucaguucacucauaacaugaacuuagccccagcugucgcccccaauuucccuggugagcagcuucuuuucuuccgcucacaguugccaucuucuggugggcggucuaacgggauucuggacugccugguuccccaggaauggguucaacacuucuaccaggaaucagccccugcccaaacacagguagcccugguuagauauguuaacccugacacugguagagugcuauuugaggccaagcuacacaaauugggcuucaugacuauagcuaagaauggugacucuccaauaacugucccuccaaauggguacuuuagguuugaaucuugggugaaccccuuuuauacacuugcccccaugggaacuggaaaugggcguagaaggauucaauaa

SEQ ID NO: 4915 - RNA, 1647 nt, Artificial Sequence
  VP1__Norovirus__AED02039
augaagauggcgucgaaugacgcugcuccaucuaacgauggugccgccggccucgucccagagaucaacaaugaggcaauggcgcuagagccaguggcaggugcagcaauagcagcaccucucacuggccagcaaaauauaauugaucccuggauuaugaauaauuuugugcaagcaccugguggugaguuuacagugucaccuaggaacuccccuggugaaguacuccuuaauuuagaauuagguccagaaauaaaccccuauuuggcucaccuugcuaggauguacaaugguuaugcagguggguuugaggugcagguaguccuggcuggaaaugcguuuacagcaggaaaggugaucuuugcagcuauaccccccaauuucccaauugauaaucugagcgcagcacagauuacaaugugcccgcaugugauuguggaugucagacaauuggaaccaaucaaccuuccgaugccugauguccguaauaacuucuuucauuauaaucaagggucugacucgagguugcgucuaauugcaauguuguauacaccucuuagggcaaauaauucaggagaugauguuuucacugugucuuguaggguauuaacuaggccuagcccugauuucucauucaauuuucucguuccgccuacuguagaaucaaaaacaaagccuuucacccuccccauuuugacuauuucugaaaugucuaauucuagauuuccagugccaauugacucucugcacaccagcccgacugagaacauuguuguccagugccaaaaugggcgcgucacccuugacggugaguuaaugggcaccacucaacucuugccgagucaaauaugugcuuucaggggcacgcucaccagaucaacaagcagggccggugaccaagcugacacggcaaccccuagauuguucaauuauuauuggcacauacaauuggauaaucuaaauggaacccccuaugacccugcagaagacauaccagccccuuugggaacaccagacuuccggggcaaggucuuuggcguagccagccagagaaacccugacagcacaacaagagcacaugaagcaaaaguggacacaacaucuggucgcuucgccccgaaauuggguucccuagaaauauccacugaauccagugacuuugacucaaaccaaccaacaagguucaccccaguuggcauugggguugacaaugaggcagauuuucaacaaugguccuuaccugacuacuccggucaguucacucauaacaugaacuuagccccagcugucgcccccaauuucccuggugagcagcuucuuuucuuccgcucacaguugccaucuucuggugggcggucucacgggauucuggacugccugguuccccaggaauggguucaacacuucuaccaggaaucagccccugcccaaacacagguagcccugguuagguauguuaacccugacacugguagagugcuauuugaggccaagcuacacaaauugggcuucaugacuauagcuaagaauggugacucuccaauaacugucccuccaaauggguacuuuagguuugaaucuugggugaaccccuuuuauacacuugcccccaugggaacuggaaacaagcguagaaggauucaauaa

SEQ ID NO: 4916 - RNA, 1623 nt, Artificial Sequence
  VP1__Norovirus__AEG79290
augaagauggcgucgaaugacgccaacccaucugauggguccgcagccaaccucgucccagaggucaacaaugagguuauggcuuuggagcccguugccggugccgcucuugcggcgccuguagcgggccaacaaaauguaauugaccccuggauuagaaauaauuuuguacaagccccugguggagaguucacaguauccccuagaaacgcuccaggugaaauacuauggagcgcgcccuuaagcccugauuugaaucccuaccuaucucauuuggccagaauguauaacaguuaugcaggugguuuugaagugcaggugauccucgcggggaacgcguucaccgccggaaaaauuauauuugcagcagucccaccaaauuuuccaauugaaggcuugagccccagucaggucacuauguucccccacauaauaguagauguuaggcaguuggaaccugugcugauucccuugccugauguuaggaacaauuucuaucauuacaaucagucaaaugagcccaccauaaaauugauagcaaugcuguacacaccacuuagggcuaauaaugcuggagaagaugucuucacagucucuugucgaguccucacgaggccauccccugauuuugauuuuauauuuuuggugccaccuacaguugagucaagaacuaaaccauucacugucccaaucuuaacuguugaagaaaugaccaauucaagauuccccaucccuuuggaaaaguuguucacgggucccagcaguagcuuuguuguucaaccacaaaauggcagaugcacgacugauggcgugcucuugggcaccacccaacugucgccugucaacaucugcaccuuuagaggggaugucacccacauugcagguucucgcaauuacacaaugaauuuggcuucuauaaauuggaacaauuaugacccaacagaagaaauuccagccccucuaggaacuccagauuucgugggaaagauccaagguaugcucacucaaaccacaaggggagacggcucgacccguggucauagagccacaguuuacacugggagugccccuuuuacuccaaagcugggcaguguucaauucacuacugacacagauaaugauuuugaaacuaaccaaaacacaaaauucaccccagucgguguuguccaggauggugacaccgcccaccgaaaugaaccccaacaaugggugcucccaaguuauucagguagaaauguccaaaauguacaccuagcuccugcuguagcccccacuuuuccgggugaacaacuucuuuucuucagguccacuaugcccggaugcagcggguauccuaacauggauuuggauugccuacucccucaggagugggugcagcacuucuaccaagaggcagccccagcacaaucugauguggcucuauugagauuugugaauccagacacggguaggguccuguuugagugcaaacuucauaaaucaggcuaugucacaguggcucacaccggccagcaugauuugguuaucccccccaauggcuauuuuagguuugauuccuggguuaaucaguucuacacacuugcccccaugggaaauggaacggggcguagacgcgccuuauaa

SEQ ID NO: 4917 - RNA, 1608 nt, Artificial Sequence
  VP1__Norovirus__AEI29586
augaagauggcgucgaaugacgccgcuccaucuaaugauggugcagccggucucguaccagaggucaacaaugagaccauggcacuugaaccgguggcuggggcuucaauagccgccccacucaccggccaaaacaauguuauagaccccuggauuagauuaaacuuugugcaggcccccaauggagaguuuacagucucaccccgcaauucgccuggggaaguucuacuaaacuuggaauuaggcccugaacuaaauccauauuuggcacaccuuuccagaauguacaaugguuaugcagguggaguugaggugcaaguacuacuggcugggaacgcguucacggcuggaaaacugguauucgcugcaguucccccucauuuuccauuagaaaacauaagcccuggccaaauaaccauguucccucauguaauuauugauguuaggacuuuagaaccaguccuauugccucuuccagauguuaggaacaacuucuuucacuacaaucagcaaaacgaaccgaggaugaggcuuguggcaaugcucuauaccccccuuagaucuaaugguucuggugaugauguauuuacugucuccuguagagugcuuacucgacccucuccugauuuugauuucaauuauuugguacccccuacaguugaaucuaaaacuaagccuuucacacucccuaucuugaccauaggggaguuaaccaauuccagauucccugugccuauagaugaacucuacacuagccccaaugagaguuuggugguacaaccccagaacgggagaugcgcgcuggauggggaguugcaggguacuacucagcuccuccccacggcgaucugcucguucaggggucggauuaaucagaaagugaguggagagaaccauguuuggaauaugcaagucaccaacauugacggaaccccuuuugauccaacagaggauguuccagcuccucuagguacaccagacuuuucuggcaagcucuuuggcguccuaagccagagggaccaugacaaugccuguaggagccaugaugcagugauugcaacuaauucugcuaaauuuaccccaaaauugggcgcuauacaaauuggcacaugggaacaagaugauguacacaucaaccaacccaccaaauuuacuccaguuggcuuguuugaaagugaagguuuuaaucaguggacacucccuaauuacucuggagccuuaacacucaacaugggguuggcccccccuguggcccccacauuuccuggcgagcaaauucuuuucuucagaucccacauuccucuuaaaggagguguggcagacccaguuauugauugucucuugccccaagaguggauccaacaccuuuaucaggagucagccccuucacaaacagauguagcacugaucagauucacaaauccagacacagggcguguccuauuugaagcaaaauugcauaggaguggcuacaucacaguggccaacacugguagcagaccaauuguggugccagcuaaugguuacuucagguuugacucuuggguuaaucaguuuuauucucucgcccccaugggaacugggaaugggcgcagaagggugcaguaa

SEQ ID NO: 4918 - RNA, 1623 nt, Artificial Sequence
  VP1__Norovirus__AEJ82646
augaagauggcgucgaaugacgccaccccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggcuagaauguacaaugguuaugcaggugguuuugaagugcagguaauccucgcggggaacguguucaccgccgggaaaaucauauuugcagcagucccaccaaauuucccaacugaaggcuugagccccagccaggucacuauguucccccauauaauaguagauguuaggcaacuggaaccuguguugauccccuugccugauguuaggaacaauuucuaucauuacaaucaaucaaaugaccccaccaucaaauugauagcaaugcuguauacaccacuuagggcuaacaaugcuggggacgaugucuucacagucucuugucgaguucucacgaggccaucccccgauuuugauuucauauuuuuggcgccacccacaguugagucaagaacuaaaccauucucugucccaaucuuaacuguugaggagaugaccaauucaagauucccuauuccuuuggaaaaguuguucacgggucccaguagugccuuuguuguucaaccacaaaauggcagaugcacgacugauggcgugcucuuagguacuacucaacugucuccugucaacaucugcaccuucagaggggaugucacccacaucgcagguacucaaaauuauacaaugaaucuggccucccaaaacuggaacaauuaugacccaacagaagaaaucccagccccucugggaaccccagauuuuguaggaaagauccaaggcgugcucacccaaaccacaaggagggauggcucgacccgcggucacaaagccacagugagcacuggaaguguccacuucaccccaaagcugggcaguauucaauucuccacugauacaagcaaugacuuugaaacuggccaaaacacgagauucaccccagucggugucguccaggaugguaguaccacccaccaaaaugaaccccaacaaugggugcucccagauuauucagguagagacagucacaauguacaccuagccccugccguggcccccacuuuuccgggugagcaacuucuuuucuuuagguccacuaugcccggaugcagcggguaucccaacaugaauuuggauugccuacuuccccaggagugggugcaacacuuuuaccaagagucagccccagcacaaucugauguggcacuacugagauuugugaauccagacacagguaggguuuuguuugagugcaagcuucauaaaucaggcuauguaacaguggcucacacuggccaacaugauuugguuauccccccuaauggcuauuuuagauuugauuccugggucaaccaauucuacacacuugcccccaugggaaauggagcggggcguagacgugcauuauaa

SEQ ID NO: 4919 - RNA, 1623 nt, Artificial Sequence
  VP1__Norovirus__AER11308
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaacuggagccuguguugaucccccugccugauguuaggaauaauuuuuaucauuauaaucaaucaaaugaccccaccaucaaauugauagcaaugcuguauacaccacucagggcuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagauucccuauuccuuuggaaaaguuguucacgggucccagcagugccuuuguuguucagccacaaaauggcagaugcacgacugauggcgugcucuuagguacuacccaacugucuccugucaacaucugcaccuucagaggggaugucacccacauugcagguacucaaaauuacacaaugaaccuggccucccaaaauuggaacaauuaugauccaacagaagaaaucccagccccucugggaaccccagauuuuguaggaaagauccaaggugugcucacccaaaccacaaggagggauggcucgacccgcggucacaaagccacagugagcacuggaaguguccacuuuaccccaaagcugggcaguguucaauucuccacugauacaagcaaugacuuugaaacuggccaaaacacgagauucaccccagucgguguuguccaggaugguaguaccacccaccaaaaugaaccccaacaaugggugcucccaaacuauucagguagagauagucacaauguacaccuagccccugccguggcccccacuuucccgggugagcaacuucuuuucuuuagguccacuaugcccggaugcagcggguaucccaacaugaauuuggauugccuacucccccaggagugggugcaacacuucuaccaagagucagccccagcacaaucugauguggcacugcugagauuugugaauccagacacagguagggucuuguuugagugcaagcuucauaaaucaggcuauguaacaguggcucacacuggccaacaugauuugguuaucccccccaauggcuauuuuagauuugauuccugggucaaccaauucuacacacuugcccccaugggaaauggagcggggcguagacgugcauuguaa

SEQ ID NO: 4920 - RNA, 1623 nt, Artificial Sequence
  VP1__Norovirus__AER11310
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugaucccccugccugauguuaggaauaauuuuuaucacuacaaucaaucaaaugaccccaccaucaaauugauagcaaugcuguauacaccacucagggcuaacaaugcuggggacgaugucuucacagucucuugucgaguucucacgagaccaucccccgauuuugauuucauauuuuuggugccacccacaguugagucgagaacuaaaccauucucugucccaaucuuaacuguugaggagaugaccaauucaagauucccuauuccuuuggaaaaguuguucacgggucccagcagugccuuuguuguucagccacaaaauggcagaugcacgacugauggcgugcucuuagguacuacccaacugucuccugucaacaucugcaccuucagaggggaugucacccacauugcggguacucaaaauuacacagugaaucuggccucccaaaauuggaacaauuaugacccaacagaagaaaucccagccccucugggaaccccagauuuuguaggaaagauccaaggcgugcucacccaaaccacaaggagggauggcucgacccgcggucacaaagccacagugagcacuggaaguguccacuuuaccccaaagcugggcaguguucaauucuccacugauacaagcaaugacuuugaaacuggccaaaacacgagguucaccccagucgguguuguccaggaugguaguaccacccaccaaaaugaaccccaacaaugggugcucccaaacuauucagguagagauagucacaauguacaccuagccccugccguggcccccacuuucccgggugagcaacuucuuuucuuuagguccacuaugcccggaugcagcggguaucccaacaugaauuuggauugccuacucccccaggagugggugcaacacuucuaccaagagucagccccagcacaaucugauguggcacugcugagauuugugaauccagacacagguagggucuuguuugagugcaagcuucauaaaucaggcuauguaacaguggcucacacuggccaacaugauuugguuaucccccccaauggcuauuuuagauuugauuccugggucaaccaauucuacacacuugcccccaugggaaauggagcggggcguagacgugcauuguaa

SEQ ID NO: 4921 - RNA, 1623 nt, Artificial Sequence
  VP1__Norovirus__AER11312
augaagauagcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccauuuggccagaauguauaauaguuaugcaggugguuuugaagugcagguaauccucgcggggaacgcguucaccgccggaaaaaucauauuugcagcagucccaccaaauuucccaacugaaggcuugagccccagccaggucacuauguucccccauauaauaguagauguuaggcaacuggaaccuguguugaucccuuuacccgauguuaggaauaauuucuaucacuacaaucaaucaaacgaccccaccaucaaauugauagcaauguuguauacaccacuuagggcuaauaaugcuggggacgaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccagcagcgccuuuguuguucaaccacaaaauggcaggugcacgacugauggcgugcucuuagguacuacccaacugucuccugucaacaucugcaccuucagaggggaugucacccacauugcuaguacucaagaauacacaaugaaucuggccucccaaaacuggaacaauuaugacccaacagaagaaaucccagccccucugggaacuccagauuucguggguaagauccaaggcgugcucacccaaaccacaaggagggauggcucgacccguggucacaaagccacagugagcacuggaaguguccacuucaccccaaagcugggcagaauucaauucuccacugauacaagcaaugauuuugaaacuggccaaaacacgagauucaccccagucgguguuguccaggaugguaguaccacccaccaaaaugaaccccaacaauggguacucccaaauuauucagguagagauagucacaaugugcaccuagccccugccguggcccccucuuuuccgggugagcaacuucuuuucuucagguccacuaugcccggaugcagcggguaucccaacaugaauuuggauugucuacucccccaggagugggugcagcacuucuaccaagaggcagccccagcacaaucugacguggcucugcuaagauuugugaauccagacacagguaggguuuuguuugaguguaagcuucauaaaucaggcuaugucacaguggcucacacuggccaacaugauuuaguuaucccccccaauggcuauuuuagauuugauuccugggucaaccaguucuacacacuugcccccaugggaaaugggacggggcguagacgugcauuauaa

SEQ ID NO: 4922 - RNA, 1623 nt, Artificial Sequence
  VP1__Norovirus__AER11314
augaagauggcgucgaaugacgccaacccaucugauggguccgcagccaaccucgucccagaggucaacaaugagguuauggcucuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggagccuguguugauccccuuaccugauguuaggaauaacuucuaucacuauaaucagucaaaugauucaaccauuaaauugauagcaaugcuguacacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcaggcacucguaauuacacaaugaauuuggcuucucuaaauuggaacaauuacgacccaacagaagaaauuccagccccucuaggaacuccagauuucgugggaaagauccaaggugugcucacucaaaccacaaagggggauggcucgacccguggccauaaagcuacaguuuacacugggagugcccccuuuacuccaaagcugggcaguguucaauucaguacugauacagaaaaugauuuugaaacucaccaaaacacaaaguucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuaaugagauuugugaauccagacacggguagaguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 4923 - RNA, 1623 nt, Artificial Sequence
  VP1__Norovirus__AER11316
augaagauggcgucgaaugacgccaacccaucugauggguccgcagccaaccucgucccagaggucaacaaugagguuauggcuuuggagcccguugucggugccgcuaucgcggcgccuguggcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagucaggucacuauguucccccacauaauaguagauguuaggcaauuggaaccuguguugauccccuuaccugauguuaggaauaacuucuaucacuauaaucagucaaaugauucuaccauuaaauugauagcaaugcuguauacaccacucagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuccauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 4924 - RNA, 1623 nt, Artificial Sequence
  VP1__Norovirus__AER11318
augaagauggcgucgaaugacgccaacccaucugauggguccgcagccaaccucgucccagaggucaacaaugagguuauggcuuuggagcccguugucggugccgcuauugcggcgccuguggcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauuccacuauuaaauugauagcaaugcuguauacaccacucagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggagaugucacccacauugcagguucucguaauuacacaaugaauuuggcuucucuaaauuggaacaauuaugacccaacagaagaaauuccagccccucuaggaacuccagauuucgugggaaaaauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaucuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuccauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 4925 - RNA, 1623 nt, Artificial Sequence
  VP1__Norovirus__AER11320
augaagauggcgucgaaugacgccaacccaucugauggguccgcagccaaccucgucccagaggucaacaaugagguuauggcuuuggagcccguugucggugccgcuauugcggcgccuguggcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaguaguagauguuaggcaauuggaaccuguguugauccccuuaccugauguuaggaauaacuucuaucacuauaaucagucaaaugauuccaccauuaaauugauagcaaugcuguauacaccacucagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuacgacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaccccaacauggauuuggauugccuacucccccaggagugggugcagcacuucuaccaagaggcagcuccagcacaaucugauguggcucuauugagauuugugaauccagacacggguaggguccuguuugagugcaaacuccauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 4926 - RNA, 1623 nt, Artificial Sequence
  VP1__Norovirus__AER11324
augaagauggcgucgaaugacgccaacccaucugauggguccgcagccaaccucgucccagaggucaacaaugagguuauggcuuuggagcccguugucggugccgcuauugcggcgccuguagcgggccaacaaaaugugauugaccccuggauuagaaauaauuuuguacaagccccugguggagaguuuacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaaugugcaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaagcuccauaaaucaggcuaugucacaguggcucacaccggccagcaugauuuggucaucccccccaauggcuauuuuagauuugauuccuggguuaaucaauucuacacacuugcccccaugggaaauggaacggggcguagacgugcuuuauaa

SEQ ID NO: 4927 - RNA, 1623 nt, Artificial Sequence
  VP1__Norovirus__AER11326
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauauuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggggugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcaacacuucuaccaagaggcagcuccagcacaaucugacguggcucuauugagguuugugaacccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 4928 - RNA, 1623 nt, Artificial Sequence
  VP1__Norovirus__AER11328
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaccagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacaacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagcuccugcuguagcccccacuuuuccgggugaacagcuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugacuuggucaucccccccaaugguuauuuuagguuugauuccuggguuaaucaguucuacacacuugcccccaugggaaauggaacggggcguagacgugcuuuauaa

SEQ ID NO: 4929 - RNA, 1623 nt, Artificial Sequence
  VP1__Norovirus__AER11330
augaagauggcgucgaaugacgccaacccaucugauggguccgcagccaaccucgucccagaggucaacaaugagguuauggcuuuggagcccguugucggugccgcuauugcggcgccuguggcgggccaacaaaauguaauugaccccuggauuagaaauaauuuuguacaagccccugguggggaguucacaguguccccuagaaacgcuccaggugaaauacuauggagcgcgcccuuaggcccugaucugaaucccuaccuaucucauuuggccagaauguauaacgguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauuccaccauuaaauugauagcaaugcuguauacaccacucagggcuaauaaugcuggggaagaugucuucacagucucuugucgaguccucacgaggccaucccccgauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaacuccagccccucuaggaacuccagauuuugugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuccauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 4930 - RNA, 1623 nt, Artificial Sequence
  VP1__Norovirus__AER11332
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccauauaauaguggauguuaggcaauuggaaccuguguugauccccuuaccugauguuaggaauaacuucuaucacuauaaucagucaaaugauucuaccauuaaauugauagcaauguuguauacaccacuuagggcuaauaaugcuggggaagaugucuucacagucucuugucgaguucucacgaggccauccccugacuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucuagaaauuacacaaugaauuuggcuucucuaaauuggaacaauuaugacccaacagaagaaauuccagccccucuaggaacuccagauuucgugggaaagauccaaggugugcuuacccaaaccacaaagggagaugguucgacccguggccauaaagcuacaguuuacacugggagugcccccuuuacuccaaaguugggcaguguucaauucaguacugauacagaaaaugauuuugaaacccaccaaaacacaaaauucaccccagucggugucauccaggaugguagcaccacccaccgaaaugaaccccaacaaugggugcucccaaguuauucagguagaaauguccaaaauguacaccuagccccugcuguggcccccacuuuuccgggugaacaacuucuuuucuuuagguccacuaugcccggaugcagcggguaucccaacauggauuuggauugccuacucccucaggagugggugcagcacuucuaccaagaggcagccccagcacaaucugauguggcucuauugagauuugugaauccagacacggguaggguccuguuugagugcaaacuucauaaaucaggcuaugucacaguagcucacaccggccagcaugauuuggucaucccccccaaugguuauuuuagguuugauuccuggguuaaucaauuuuacacacuugcccccaugggaaauggaacggggcguagacgugcuuuauaa

SEQ ID NO: 4931 - RNA, 1623 nt, Artificial Sequence
  VP1__Norovirus__AER11334
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucuuacgaggccauccccugauuuugauuuuauauuuuuggugccaccuacaguugagucaagaacuaaaccauuuacugucccaaucuuaacuguugaagaaaugaccaauucaagauuccccauuccuuuggaaaaacuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaguucaguacugauacagaaaaugauuuugaaacucaccaaaacacaaaauucaccccagucggugucauccaggauggcagcaccacccaccgaaaugaaccccaacaauggguacucccaaguuauucagguagaaauguccauaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuccauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 4932 - RNA, 1623 nt, Artificial Sequence
  VP1__Norovirus__AER11336
augaagauggcgucgaaugacgccagcccaucugauggguccgcagccaaccucgucccagaggucaacaaugagguuauggcuuuggagcccguugucggugccgcaauugcggcgccuguagcgggccaacaaaauguaauugaccccuggauuagaaauaauuuuguacaagccccugguggagaguucacaguauccccuagaaacgcuccaggcgaaauauuguggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccagguuaccauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccaucccccgauuuugauuuuauauuuuuggugccaccuacaguugagucaagaacuaaaccauucacugucccaaucuuaacuguugaagaaaugacuaauucaagauuccccauuccuuuggaaaaguuguucacgggucccagcggcgccuuuguuguucaaccacaaaauggcagaugcacgacugauggcgugcuccuaggcaccacccaacugucuccugucaacaucugcaccuucagaggggaugucacccacauugcagguucucguaacuacacaaugaauuuggcugcucugaauuggaacaauuaugacccaacagaagaaauuccagccccucuaggaaccccagauuucgugggaaagauccaaggugugcucacucaaaccacaaaggcagauggcucgacccguggccauaaagcuacaguuuauacugggagugccgacuuuacuccaaagcugggcaguguucaauucaauacugauacagaaaaugauuuugaaacucaccaaaacacaaaauucaccccagucggugucauccaggaugguagcaccacccaccgaaaugaaccccaacaaugggugcucccgaguuauucagguagaaauguccauaauguacaccuagccccugcuguagcccccaccuuuccgggugaacaacuucuuuucuucagguccacuaugcccggaugcagcggguaucccaacauggauuuggauugccuacucccccaagagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugacuuggucaucccccccaauggcuauuuuagguuugauuccuggguuaaucaauucuacacacuugcccccaugggaaauggaacggggcguagacgugcuuuauaa

SEQ ID NO: 4933 - RNA, 1623 nt, Artificial Sequence
  VP1__Norovirus__AER11340
augaagauggcgucgaaugacgccagcccaucugauggguccgcagccaaccucgucccagaggucaacaaugagguuauggcuuuggagcccguugucggugccgcaauugcggcgccuguagcgggccaacaaaauguaauugaccccuggauuagaaauaauuuuguacaagccccugguggagaguucacaguauccccuagaaacgcuccaggcgaaauauuguggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccagguuaccauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccaucccccgauuuugauuuuauauuuuuggugccaccuacaguugagucaagaacuaaaccauuuacugucccaaucuuaacuguugaagaaaugacuaauucaagauuccccauuccuuuggaaaaguuguucacgggucccagcggcgccuuuguuguucaaccacaaaauggcagaugcacgacugauggcgugcuccuaggcaccacccaacugucuccugucaacaucugcaccuucagaggggaugucacccacauugcagguucucguaacuacacaaugaauuuggcugcucugaauuggaacaauuaugacccaacagaagaaauuccagccccucuaggaaccccagauuucgugggaaagauccaaggugugcucacucaaaccacaaaggcagauggcucgacccguggccauaaagcuacaguuuauacugggagugccgacuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccgaguuauucagguagaaauguccauaauguacaccuagccccugcuguagcccccaccuuuccgggugaacaacuucuuuucuucagguccacuaugcccggaugcagcggguaucccaacauggauuuggauugccuacucccccaagagugggugcagcacuucuaccaagaggcagcuccagcacaaucugauguggcucuauugagauuugugaauccagauacggguaggguccuguuugagugcaaacuucauaaaucaggcuaugucacaguggcucacaccggccagcaugacuuggucaucccccccaauggcuauuuuagguuugauuccuggguuaaucaauucuacacacuugcccccaugggaaauggaacggggcguagacgugcuuuauaa

SEQ ID NO: 4934 - RNA, 1623 nt, Artificial Sequence; identical to SEQ ID NO: 4933
  VP1__Norovirus__AER11342

SEQ ID NO: 4935 - RNA, 1623 nt, Artificial Sequence
  VP1__Norovirus__AER11344
augaagauggcgucgaaugacgccagcccaucugauggguccgcagccaaccucgucccagaggucaacaaugagguuauggcuuuggagcccguugucggugccgcaauugcggcgccuguagcgggccaaaaaaauguaauugaccccuggauuagaaauaauuuuguacaagccccugguggagaauucacaguauccccuagaaacgcuccaggcgaaauauuguggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccagguuaccauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccaucccccgauuuugauuuuauauuuuuggugccaccuacaguugagucaagaacuaaaccauuuacugucccaaucuuaacuguugaagaaaugacuaauucaagauuccccauuccuuuggaaaaguuguucacgggucccagcggcgccuuuguuguucaaccacaaaauggcagaugcacgacugauggcgugcuccuaggcaccacccaacugucuccugucaacaucugcaccuucagaggggaugucacccacauugcagguucucguaacuacacaaugaauuuggcugcucugaauuggaacaauuaugacccaacagaagaaauuccagccccucuaggaaccccagauuucgugggaaagauccaaggugugcucacucaaaccacaaaggcagauggcucgacccguggccauaaagcuacaguuuauacugggagugccgacuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccgaguuauucagguagaaauguccauaauguacaccuagccccugcuguagcccccaccuuuccgggugaacaacuucuuuucuucagguccacuaugcccggaugcagcggguaucccaacauggauuuggauugccuacucccccaagagugggugcagcacuucuaccaagaggcagcuccagcacaaucugauguggcucuauugagauuugugaauccagacacggguaggguccuguuugagugcaaacuccauaaaucaggcuaugucacaguggcucacaccggccagcaugacuuggucaucccccccaauggcuauuuuagguuugauuccuggguuaaucaauucuacacacuugcccccaugggaaauggaacggggcguagacgugcuuuauaa

SEQ ID NO: 4936 - RNA, 1623 nt, Artificial Sequence
  VP1__Norovirus__AER11346
augaagauggcgucgaaugacgccagcccaucugauggguccgcagccaaccucgucccagaggucaacaaugagguuauggcuuuggagcccguugucggugccgcaauugcggcgccuguagcgggccaacaaaauguaauugaccccuggauuagaaauaauuuuguacaagccccugguggagaguucacaguauccccuagaaacgcuccaggcgaaauauuguggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccagguuaccauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccaucccccgauuuugauuuuauauuuuuggugccaccuacaguugagucaagaacuaaaccauucacugucccaaucuuaacuguugaagaaaugacuaauucaagauuccccauuccuuuggaaaaguuguucacgggucccagcggcgccuuuguuguucaaccacaaaauggcagaugcacgacugauggcgugcuccuaggcaccacccaacugucuccugucaacaucugcaccuucagaggggaugucacccacauugcagguucucguaacuacacaaugaauuuggcugcucugaauuggaacaauuaugacccaacagaagaaaucccagccccucuaggaaccccagauuucgugggaaagauccaaggugugcucacucaaaccacaaaggcagauggcucgacccguggccauaaagcuacaguuuauacugggagugccgacuuuacuccaaaacugggcaguguucaauucaguacugauacagaaaaugauuuugaaacucaccaaaacacaaaauucaccccagucggugucauccaggaugguagcaccacccaccgaaaugaaccccaacaaugggugcucccgaguuauucagguagaaauguccauaauguacaccuagccccugcuguagcccccaccuuuccgggugaacaacuucuuuucuucagguccacuaugcccggaugcagcggguaucccaacauggauuuggauugccuacucccccaagagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugacuuggucaucccccccaauggcuauuuuagguuugauuccuggguuaaucaauucuacacacuugcccccaugggaaauggaacggggcguagacgugcuuuauaa

SEQ ID NO: 4937 - RNA, 1623 nt, Artificial Sequence
  VP1__Norovirus__AER11348
augaagauggcgucgaaugacgccagcccaucugauggguccgcagccaaccucgucccagaggucaacaaugagguuauggcuuuggagcccguugucggugccgcaauugcggcgccuguagcgggccaacaaaauguaauugaccccuggauuagaaauaauuuuguacaagccccugguggagaguucacaguauccccuagaaacgcuccaggcgaaauauuguggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagcuccagccagguuaccauguucccccacauaauaguagauguuaggcaauuggaaccuguguugauccccuuaccugauguuaggaauaacuucuaucauuauaaucagucaagugauucuaccauuaaauugauagcaaugcuguauacaccacuuagggcuaauaaugcuggggaagaugucuucacagucucuugucgaguccucacgaggccaucccccgauuuugauuuuauauuuuuggugccaccuacaguugagucaagaacuaaaccauuuacugucccaaucuuaacuguugaagaaaugacuaauucaagauuccccauuccuuuggaaaaguuguucacgggucccagcggcgccuuuguuguucaaccacaaaauggcagaugcacgacugauggcgugcuccuaggcaccacccaacugucuccugucaacaucugcaccuucagaggggaugucacccacauugcagguucucguaacuacacaaugaauuuggcugcucugaauuggaacaauuaugacccaacagaagaaauuccagccccucuaggaaccccagauuucgugggaaagauccaaggugugcucacucaaaccacaaaggcagauggcucgacccguggccauaaagcuacaguuuauacugggagugccgacuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccgaguuauucagguagaaauguccauaauguacaccuagccccugcuguagcccccaccuuuccgggugaacaacuucuuuucuucagguccacuaugcccggaugcagcggguaucccaacauggauuuggauugccuacucccccaagagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugacuuggucaucccccccaauggcuauuuuagguuugauuccuggguuaaucaauucuacacacuugcccccaugggaaauggaacggggcguagacgugcuuuauaa

SEQ ID NO: 4938 - RNA, 1623 nt, Artificial Sequence
  VP1__Norovirus__AER11350
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaagcaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccacauaauaguagauguuaggcaauuggaaccuguguugauccccuuacccgauguuaggaauaauuucuaucacuacaaucaaucaaaugaccccaccaucaaauugauagcaauguuguauacaccacuuagggcuaauaaugcuggagacgaugucuucacaguuucuugucggguucucacgagaccaucccccgacuuugauuucauauuuuuaguaccacccacaguugagucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgacugauggcguguuccuaggcaccacucaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucguggggaagauucaaggugugcucacccaaaccacaagggcagauggcucgacccgcggccauaaagcuacaguguacacugggagcgccgauuuugcuccaaaacuggguagaguucaauuugccacugacacagacaaugauuuugaugcuaaccaaaacacaaaguucaccccagucggugucauccaggauggugauacugcccaccgaaaugaaccccaacaaugggugcucccaaguuacucaggcagaaauagucauaaugugcaccuggcccccgcuguagcccccacuuuuccgggugagcaacuucucuucuucagauccacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugagugcaagcuucauaaaucaggcuauguuacaguggcucacaccggccaacaugauuugguuaucccccccaaugguuauuuuagauuugauuccugggucaaccaguucuacacacuugcccccaugggaaauggaacggggcguagacgugcauuauaa

SEQ ID NO: 4939 - RNA, 1623 nt, Artificial Sequence
  VP1__Norovirus__AER11352
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccacauaauaguagauguuaggcaauuggaaccuguguugauccccuuacccgauguuaggaauaauuucuaucacuacaaucaaucaaaugaccccaccaucaaauugauagcaauguuguauacaccacuuagggcuaauaaugcuggagacgaugucuucacaguuucuugucggguucucacgagaccaucccccgacuuugauuucauauuuuuaguaccacccacaguugagucaagaacuaaaccauucucugucccaauuuuaacuguugaggagaugaccaauucaagguuccccauuccuuuggaaaagcuguucacgggucccagcagugccuuuguuguucaaccacaaaacggcaggugcacgacugauggcgugcuccuaggcaccacucaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucguggggaagauucaaggugugcucacccaaaccacaagggcagauggcucgacccgcggccauaaagcuacaguguacacugggagcgccgauuuugcuccaaaacuggguagaguucaauuugccacugacacagacaaugauuuugaugcuaaccaaaacacaaaguucaccccagucggugucauccaggauggugguacugcccaccgaaaugaaccccaacaaugggugcucccaaguuacucaggcagaaauagucauaaugugcaccuggcccccgcuguagcccccacuuuuccgggugagcaacuucucuucuucagauccacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugauuugguuaucccccccaaugguuauuuuagauuugauuccugggucaaccaguucuacacacuugcccccaugggaaauggaacggggcguagacgugcauuauaa

SEQ ID NO: 4940 - RNA, 1623 nt, Artificial Sequence
  VP1__Norovirus__AER11354
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucauuauaaucagucaaaugauuccaccauuaaguugauagcaaugcuguauacaccacuuagggccaauaaugccggggaugaugucuucacagucucuugucgaguccucacgaggccauccccugauuuugacuucauauuuuuggugccaccuacaguugagucaagaacuaagccauuuacugucccaaucuugacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcggguucucguaauuacacaaugaauuuggccucucuaaauuggaacaauuaugacccaacagaagaaauuccagccccucugggaacuccagauuucgugggaaagauccaaggugugcucacucaaaccacaaagggggauggcucgacccggggccauaaagcuacagucuacacugggagugccgacuuuacuccaaagcugggcaguguucaauuugcuacugauacagaaaaugauuuugaaacucaccaaaacacaaaauucaccccagucggugucauccaggaugguagcaccacccaccgaaaugaaccccaacaaugggugcccccaaguuauucagguagaaauguccauaauguacaccuagccccugcuguagcccccaauuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguagggucuuguuugagugcaaacuucauaaaucaggcuaugucacaguggcucacaccggccaacaugauuuggucaucccccccaaugguuauuuuagguuugauuccuggguuaaucaauucuauacacuugccccuaugggaaauggaacggggcguagacgagcuuuauaa

SEQ ID NO: 4941 - RNA, 1623 nt, Artificial Sequence
  VP1__Norovirus__AER11356
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucauuauaaucagucaaaugauuccaccauuaaguugauagcaaugcuguauacaccacuuagggccaauaaugccggggaugaugucuucacagucucuugucgaguccucacgaggccauccccugauuuugacuucauauuuuuggugccaccuacaguugagucaagaacuaagccauucacugucccaaucuugacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcggguucucguaauuacacaaugaauuuggccucucuaaauuggaacaauuaugacccaacagaagaaauuccagccccucugggaacuccagauuucgugggaaagauccaaggugugcucacucaaaccacaaagggggauggcucgacccggggccauaaagcuacagucuacacugggagugccgacuuuacuccaaagcugggcaguguucaauuugcuacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccaauuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguagggucuuguuugagugcaaacuucauaaaucaggcuaugucacaguggcucacaccggucaacaugauuuggucaucccccccaaugguuauuuuagguuugauuccuggguuaaucaauucuauacacuugcccccaugggaaauggaacggggcguagacgagcuuuauaa

SEQ ID NO: 4942 - RNA, 1623 nt, Artificial Sequence
  VP1__Norovirus__AER11358
augaagauggcgucaagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugacuccaccaucaaauugauagcaauguuguacacaccacuuagggcuaauaaugccggggacgaugucuucacaguuucuugucgaguucucacgagaccaucccccgauuuugauuuuauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaucaaaacacaaaguucacuccagucggcguuauccaggaugguaguacuaccccccgaaaugaaccccaacaaugggugcucccaaguuacucaggcagaaacauucacaaugugcaccuggcccccgcuguagcccccacuuucccgggcgagcagcuccucuucuucagaucuacuaugcccggaugcagcggguaccccaacauggacuuggacugucugcucccccaggaauggguacaguacuucuaccaggaggcagccccagcacaaucugauguggcucuguuaagauuugugaauccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacgugcauuauaa

SEQ ID NO: 4943 - RNA, 1623 nt, Artificial Sequence
  VP1__Norovirus__AER11360
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuaggaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuuuccaacugaagguuugagccccagccaagucacuauguucccccaccuaauaguagauguuaggcaauuggaaccuguguugauccccuuacccgauguuaggaauaauuucuaccauuauaaucaaucaaaugacuccaccaucaaauugauagcaauguuguacacaccacuuagggcuaauaaugccggggacgaugucuuuacaguuucuugucgaguucucacgagaccaucccccgauuuugauuucauauuuuuggugccacccacaguugaaucaagaacuaaaccauucucugucccaguuuuaacuguugaggagaugaccaacucaagguuccccauuccuuuggaaaaauuguucacgggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaaccccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauucacaaugugcaccuggcccccgcuguagcccccacuuucccgggcgagcagcuucucuucuucagaucuacuaugcccggaugcagcggguaccccaacauggacuuggacugucugcucccccaggaaugggugcaguacuucuaccaggaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 4944 - RNA, 1647 nt, Artificial Sequence
  VP1__Norovirus__AEX10549
augaagauggcgucgaaugacgcugcuccaucuaaugauggugccgccggccucguaccagagaucaauaaugaggcaauggcgcuagaaccaguggcgggugcagcgauagcagcaccccuuacuggccagcaaaauauaauagaucccuggauuaugaauaauuuugugcaagcaccugguggugaguuuacagugucaccuaggaacuccccuggugaaguacuuuuaaauuuagaauuaggcccagaaauaaaucccuaucuggcacaucuugcuaggauguacaaugguuaugcagguggguuugaggugcaggugguccuggcuggaaaugcguuuacagcagggaaagugaucuuugcagcuauaccccccaauuucccaacugacaauuugagugcagcgcagauuacaauguguccucaugugauuguggacgucaggcaguuggaaccaaucaaccucccaaugccugauguccgcaauaauuucuuucauuacaaucaagguucugauucgagauuacgcuuaguugcaauguuguauacaccccuuagggcaaauaauucuggagaugauguuuucacugugucauguaggguguugacuaggcccaguccugauuucucauucaacuuccucgucccacccacuguggaaucaaagacaaaaccuuuuacccucccuauuuugacuaucucugagaugucuaauucuagauuuccagugccaauugacucucugcacaccaguccgacugauaacauuguuguccagugccaaaaugggcgcgucacccuugauggugagcuaaugggcaccacucaacucuugccgagucagauaugugcuuuuaggggugugcucaccagaucaacaagcagggccagugaccaagcugacacagcaacccccagacucuucaacuaccacuggcacauacaacuggacaaccuaaaugggaccccauaugauccugcagaggacauaccagcuccucuggggacgccagacuuucggggcaaagucuuuggcguggccagccagagaaacccugacagcacaacaagggcacaugaggcaaaaguggacacaacaucuggccgcuucaccccaaaauugggcucccuagaaauauccacugaaucuggugacuuugaccaaaaucaaccaacaagauucaccccaguuggcaucggaguugacaaugaggcagacuuucaacaauggaccuuaccugacuauuccggucaguucacccacaauaugaaucuggccccagcugucgcucccaacuuucccggcgaacagcuucuuuucuuccgcucacauuugccauccucuggcgggcgguccaaugguauucuagacugccuggucccccaggaauggguccaacacuucuaccaggaauccgccccugcccaaacgcagguggcucuggucagguaugucaacccugauacugguaggguguuauuugaggcuaagcugcauaagcuaggcuucaugaccauagcuaagaguggugauucuccaauaacuguaccuccaaauggauacuuuagguuugaaucuugggugaaccccuuuuauacauuagcccccaugggaacugggaaugggcguagaaggauucaauaa

SEQ ID NO: 4945 - RNA, 1623 nt, Artificial Sequence
  VP1__Norovirus__AEX91910
augaagauggcgucgagugacgccaacccaucugauggguccacagccaaccuugucccagaggucaacaaugagguuauggcuuuggagcccguaguuggugccgcuauugcggcaccuguagcgggccaacaaaauguaauugaccccuggauuagaaacaauuuuguacaagccccugguggagaguuuacaguauccccuagaaaugccccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccgaauuucccaacugaagguuugagccccagccaggucacuauguucccccacauaauaguagauguuaggcaauuggaaccuguguuaauccccuuacccgauguuaggaauaauuucuaccauuauaaucaaucaaaugaucccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggaugucacccauauuccaggcagucguaacuacacaaugaauuuggccucccaaaauuggaacaguuacgauccaacagaagaaaccccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucauaaugugcaccuggcccccgcuguggcccccacuuucccgggcgagcagcuccucuucuucagaucuacuaugcccggaugcagcggguaccccaauauggacuuggacugucugcucccccaggaaugggugcaguauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 4946 - RNA, 1737 nt, Artificial Sequence
  VP1__Norovirus__AFD30970
augaagauggcgucuagcgacgccaccccaucgucugauggugcuggcaaccucguuccagagagucaacaagaggucuugccacuugcuccuguggcgggcgcggccuuagccgcaccagucguggggcaacagaacauaauugaccccuggaucaaagaaaauuuugugcaggcuccccagggugaguucaccguuucaccuaagaacuccccuggcgagguccuagucaauuuggagcugagcccuagauugaacccuuauuuggaucaccuuucaaagauguauaaugccuaugcugguggcauggagguugagauaauccucgcggggaacgcuuucacugcuggcaaagugcucauugcagcggugccaccaaacuuccccaucgagaacaucucggccucucaggcuagccaguucccccaugugauuguggaugucagaacucucgaacccauucgccuacccuugcccgaugugcgcaccaacuucuuccacuacaccacacaggaggagcccagaaugcgcaucgucgcuuggcucuacaccccgcugaggacgaacggcagcggcgaugacuccuucacagucucugggcgcauuuugacacgcccauccccagauuuugaguuuuccuuccugguuccgccaacugucgagacuaagaccgucucguucucagucccuggcuuggucgucgaggauauguccaacuccagguggccugcccagaucaacggguuggucguuaggggcaaugaggcccagguugugcacuuucaaaauggcaggugcaccaccgaaggcacgcuccuuggcacgaccacgcucagcaucaacuccaucugcggacugcggggacucucagucucccaagccuccgugcgcggcgcccccgcgcucaccgaggagaugccgccucucgaggaugagguggcugacggugccgccgccaccuacacccucgcccgugccgcggacaccacgcuguggcugaggguggaggaacccgauggccgucccuaugacaucuucggggaccagccggcgccccuagggacacccgauuucacggcagugauugucggcaccgccaucaggccccguaccgcgucuggcgcguaccuccacgacgccuacguggacaccacuccuggugacgcugacuucacucccuccacuggcaacaccaagaucgugcugcgagguggugguucuggccacgucggccaaggccacuacuggcaguuuaggccgaucgcugucgagggugguggaaguagaccccaguaccaggaguauaaucugcccgauuacgccgggccgaccgcguccaaccaugaucuggcaccaccggucgccccuagaaugcccggugagcuccuguuacucuuugaaucugacaugccugugugggacaacggggcuggcgcggcacccgcgcagaaaauucauugccuucuccccaaugaguuuauaacccaccuguucgaucuucaagccccggcucucgccgaggcggcccucuugagguauguccacccugacagcggcagaacccucuuugaauguaagcucuacagggagggcuacauggucguggccgcaccagcugguaggcugaauuucccgcucgauggguacuucagguuugauucuuggguuagugcauucuacauccuuucccccgugggaagcggccaaggccgucggggcagguccaaagcugcauaa

SEQ ID NO: 4947 - RNA, 1623 nt, Artificial Sequence
  VP1__Norovirus__AFH88383
augaugauggcgucuaaggacgccccaacauccccugauggcgccaguggcgccggccagcugguaccggaggcuaauacagcugagcaaauuucaauggacccuguugcgggugcuucaacagcagucgcgacggcuggacaaguaaauaugauugacccuuggauuuuuaauaauuuuguccaggcaccucaaggagaauucacuauuuccccuaauaauacccccggugauauuuuguuugauuuacaauugggaccccaccuuaacccauuucuagcccaucucucacagauguauaaugguugggucggcaauaugcgugugcgcauacuguuggccgggaaugccuuuacagcuggaaagauaaucauuugcuguguccccccugguuuugaugcuagaauacucacuauagcucaagcaacccucuucccacacuuaauugcugauguaaggacccuugagccuguggagcuuccuuuggaggaugugcgcaacguucucuaccacaauaguagccagccgcagccaacaaugcggcugguugcuauguuguacacuccccuccgcacugguggugguuccggaggcacugaugccuuugugguggcggguagggugcuuacgugccccgcccccgauuuuaguuuucuguuucuuguucccccuuccguugaacagaagacuagaguuuucaguguccccaauauaccccuuaaagaucucucaaauucucgugucccugugcccguacagggcauguuuauguccccagauguuaaucagucaguccaguuucagaaugggcguugccaaauugauggucaacuccagggcaccaccccagucucgcucagccaacucugcaagauuagggguaaaacuucuagcaaugcuagggugcucaacuuaagugagguggauggcacaccuuuuaucccccuugagucaccagcgccagucgguuuucccgacuugggagguugugacuggcauguaaauuucacuuuccaggcccaaaaucaggacccaucccaaagugugaccuuugcaacuaaugaugcuagcuuugucccuuaccuagguagcauuuccccucacaaugggggggauuuucaugcaggugacaucauagguagccuuggauggauuucagcuccgucugacaacucacaacuuaauguuuggacaauaccaaaguauggaucuagucucccagaugucacccaccuugcuccugcuguguuccccccaggcuuuggggaagugauccuauacuucuauucuaccuucccagguucugggcaaccuagucaacuucaagucccauguuuguuaccccaggaguucaucacucacuucuguaaugaacaagcucccauugcuggggaggcugcccuccuccacuacguggacccugauacgggccggaacuugggggaguucaaacuuuacccugauggauuuaugaccugugucccuaauaguguuaguaguggcccucaaacccuaccuaucaauggagucuuugucuuuguuucauggguguccagauucuaucaacucaagccugugggaacggccucagcggcuagaaggcuuggacugcggcgcauauaa

SEQ ID NO: 4948 - RNA, 1671 nt, Artificial Sequence
  VP1__Norovirus__AFJ21376
augaagauggcgucgagugacgcugcuccaucuacggauggugcgggcaaccucguuccagagagucaacaagagguguugccccucgccccaguugcaggcgcugcguuagcggcaccuguggugggacaaacaaauauaauugaccccuggauuaaagaaaauuuuguucaagccccccagggugaguuuacugucucaccuaaaaauucuccuggugaaauuuuaguuaauuuggaauugggacccaaacucaaccccuaucuagaccaccuuucacgcauguauaauucauaugcuggugguauagaugucauggugguguuggcgggcaacgccuucacagccggcaagguuuuaauagcagcuauccccccaaauuucccaguggaaggaguguccgcuucacaggccacucaauucccccaugugauuauagauguuaggacacuugacccugugcggcucccccucccggaugugcgauccacguucuuccauuauacuaaugauacugaaccaaagaugagguuaguuauuuggcuuuacaccccacuuagaacuaauggcaguggugaugauucuuucacugucucugggcgcauacucacaaggcccucccaggacuuugaguuugcuuuccuuauccccccaacaguggaaacaaagacaacccccuuuucagugccaggcuucucagugcaggaaauguccaacucaagguggccagcugccaucucugcaauggucguccgugggaaugagccccaagucguucaguuccagaauggcagggcccaucuggaugguaugcugcuugguacgacaccugugucgcccaauuacauagcauccuaccgaggcauuuccacuggcaacucucguucugcuuccucugaggccgacgagagggccguugguagcuuugauguguggguccgcuuacaagaaccugauggccagcccuaugacaucuuugguaagcagccagccccaauuggcaccccugauuucaaggccgugauaguuggcuuugcagccaggccccucacauccggauccuacgcaaaugaagcguauguuaacaccacagccagugacuacgccccagccacugguaauaugcgcuucacagucaggaacggcgggaccgggcacauaucugcaaacaaauacugggaguucaaaucauuugguguugaaggagaaaggcacacugacauccaguaccaggaguaugagcuucccgauuauucuggucaaguugcuuccaaccauaaucuggcccccccuguagccccacgcaugccuggugagucacuauugcuuuuccaaucaaauaugccugugugggaugaugggcauggagaguccacacccaagaagauucauugccucuugccacaggaguuuauuggccauuucuuugacaggcaagcccccucucuaggugaugcugcacuacuuagguaugucaaccaggagacaaauagaguguuguuugaguguaaacuuuauagggauggcuacaucacaguugcagcaucaucaggauuauuagauuuccccuuggauggcuucuuuagguuugauucuuggguuaguucuuuuuacauuuuaucccccgugggaagcggccaaggccgcagggguagagugagguuucaauaa

SEQ ID NO: 4949 - RNA, 1608 nt, Artificial Sequence
  VP1__Norovirus__AFJ21379
augaagauggcgucgagugacgccgcuccaucuaaugauggugcagccggucucguaccagaggucaacaaugagaccauggcacuugaaccgguggcuggggcuucaauagccgccccacucaccggucaaaauaauguuauagaccccuggauuagauuaaacuuugugcaagcucccaauggagaguuuacaguuucaccccgcaacucgccuggggaaguccuacuaaacuuggaauuaggcccugaacuaaauccauauuuggcacaccuuuccagaauguacaaugguuaugcagguggaguugaggugcaaguacuacuggcugggaacgcguucacggcuggaaaacugguauucgccgcaguucccccucauuuuccauuagaaaacauaagcccuggccaaauaaccauguucccucauguaauuauugauguuaggacuuuagaaccaguccuauugccucuuccagauguuaggaacaauuucuuucacuacaaucagcaaaacgaaccgaggaugaggcuuguggcaaugcucuauaccccccuuaggucuaaugguucuggugaugauguauuuacugucuccuguagagugcuuacucgacccucuccugauuuugauuucaauuauuugguacccccuacaguugaaucuaaaacuaaacccuucacacuccccaucuugaccaugggggaguuaaccaauuccagauucccugugccuauagaugaacucuacacuagccccaaugagaguuuggugguacaaccccagaacgggagaugcgcgcuggauggggaguugcaggguacuacucagcuccuccccacggcgaucugcucguucaggggucggauuaaucagaaagugaguggagauaaccauguuuggaauaugcaaguuaccaacauuaacggaaccccuuuugauccaacagaggauguuccagcuccucuagguacaccagacuuuucugguaagcucuuuggcguccuaagccagagggaccaugacaaugccuguaggagccaugaugcagugauugcaacuaauucugcuaaauuuaccccaaaauugggcgcuauacaaauuggcacaugggaacaagaugauguacacaucaaccaacccaccaaauucacuccaguuggcuuguuugaaagugaagguuuuaaucaguggacacucccuaauuauucuggagccuuaacacucaacaugggguuggcccccccuguggcccccacauuuccuggcgagcaaauucuuuucuucagaucccacauuccucuuaaaggagguguggcagacccaguuauugauugucucuugccccaagaguggauccaacaccuuuaucaggagucagccccuucacaaacagauguagcacugaucagauucacaaauccagacacagggcguguccuauuugaagcaaaauugcacaggaguggcuacaucacaguggccaacacugguagcagaccaauuguggugccagcuaaugguuacuucagguuugacucuuggguuaaucaguuuuauucucucgcccccaugggaacugggaaugggcgcagaagggugcaguaa

SEQ ID NO: 4950 - RNA, 1608 nt, Artificial Sequence
  VP1__Norovirus__AFJ21382
augaagauggcgucgaaugacgccgcuccaucuaaugauggugcagccggucucguaccagaggucaacaaugagaccauggcacuugaaccgguggcuggggcuucaauagccgccccacucaccggucaaaauaauguuauagaccccuggauuagauuaaacuuugugcaagcucccaauggagaguuuacaguuucaccccgcaauucgccuggggaaguccuacuaaacuuggaauuaggcccugaacuaaauccauauuuggcacaccuuuccagaauguacaaugguuaugcagguggaguugaggugcaaguacuacuggcugggaacgcguucacggcuggaaaacugguauucgccgcaguucccccucauuuuccauuagaaaacauaagcccuggccaaauaaccauguucccucauguaauuauugauguuaggacuuuagaaccaguccuauugccucuuccagauguuaggaacaauuucuuucacuacaaucagcaaaacgaaccgaggaugaggcuuguggcaaugcucuacaccccccuuaggucuaaugguucuggugaugauguauuuacugucuccuguagagugcuuacucgacccucuccugauuuugauuucaauuauuugguacccccuacaguugaaucuaaaacuaaacccuucacacuccccaucuugaccauaggggaguuaaccaauuccagauucccugugccuauagaugaacucuacacuagccccaaugagaguuuggugguacaaccccagaacgggagaugcgcgcuggauggggaguugcaggguacuacucagcuccuccccacggcgaucugcucguucaggggucggauuaaucagaaagugaguggagagaaccauguuuggaauaugcaagucaccaacauuaacggaaccccuuuugauccaacagaggauguuccagcuccucuagguacaccagacuuuucuggcaagcucuuugguguccuaagccagagggaccaugauaaugccuguaggagccaugaugcagugauugcaacuaauucugcuaaauuuaccccaaaauugggcgcuauacaaauuggcacaugggaacaagaugauguacacaucaaccaacccaccaaauuuacuccaguuggcuuguuugaaagugaagguuuuaaucaguggacacucccuaauuauucuggagccuuaacacucaacaugggguuggcccccccuguggcccccacauuuccuggcgagcaaauucuuuucuucagaucccacauuccucuuaaaggagguguggcagacccaguuauugauugucucuugccccaagaguggauccaacaccuuuaucaggagucagccccuucacaaacagauguagcacugaucagauucacaaauccagacacagggcguguccuauuugaagcaaaauugcacaggaguggcuacaucacaguggccaacacugguagcagaccaauuguggugccagcuaaugguuacuucagguuugacucuuggguuaaucaguuuuauucucucgcccccaugggaacugggaaugggcgcagaagggugcaguaa

SEQ ID NO: 4951 - RNA, 1623 nt, Artificial Sequence
  VP1__Norovirus__AFJ21387
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguaucccccagaaacgcuccaggugaaauacuguggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaauuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauuaagauuugugaauccagauacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 4952 - RNA, 1623 nt, Artificial Sequence
  VP1__Norovirus__AFJ21388
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucacuuggccagaauguauaaugguuaugcaggcggcuuugaagugcaggugauccucgcggggaacgcguucaccgccgggaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaccauuauaaucagucaaaugauucuaccauuaaauugauagcaaugcuguauacaccacuuagggccaauaaugcuggggaagaugucuucacagucucuugucgaguccucacgaggccguccccugauuuugauuuuauauuuuuggugccacccacaguugagucaagaacuaagccauuuacugucccaaucuuaacuguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccacaauguacaccuagccccugcuguagcccccacuuuuccgggugaacaacuucuauucuucagguccacuaugcccggaugcagcggguaucccaacauggauuuggauugccuacucccccaggagugggugcagcacuucuaccaagaggcagcuccagcacaaucugacguggcccuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcgcagacgugcuuuauaa

SEQ ID NO: 4953 - RNA, 1623 nt, Artificial Sequence
  VP1__Norovirus__AFJ21389
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggccaauaaugcuggggaggaugucuucacagucucuugucgaguccucacgaggccguccccugauuuugauuucauauuuuugguaccacccacaguugagucaagaacuaaaccauuuacugucccaaucuuaacuguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuuuagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguccaauucaguacugauacagaaaaugauuuugaaacucaccaaaacacaaaauucaccccagucggugucauccaggaugguagcaccacccaccgaaaugaaccccaacaaugggugcucccaaguuacucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaucaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugacuccuggguuaaucaauucuacacacuugcccccaugggaaauggaacggggcguagacgugcuuuauaa

SEQ ID NO: 4954 - RNA, 1623 nt, Artificial Sequence
  VP1__Norovirus__AFJ21390
augaagauggcgucgaaugacgccaacccaucugauggguccgcagccaaccucgucccagaggucaacaaugagguuauggcuuuggagcccguugucggugccgcuaucgcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucacuuggccagaauguauaaugguuaugcaggugguuuugaagugcaggugauccucgcggggaacgcguucaccgccggaaaaauuauauuugcagcagucccaccaaauuucccaacugaaggcuugagucccagccaggucacuauguucccccacauaauaguggauguuagacaauuggaaccuguguugauccccuuaccugauguuaggaauaacuucuaucacuauaaucagucaaaugauucuaccauuaaauugauagcaaugcuguauacaccacuuagggcuaacaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacgcaaugaauuuggcuucucuaaauuggaacaauuaugacccaacagaagaaauuccagccccucuaggaacuccagauuucgugggaaagauccaagguuugcucacucaaaccacaaagggagauggcucgacccguggccauaaagcuacaguuuacacugggagugcccccuuuacuccaaaguugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuuuagguccacuaugcccggaugcagcggguaucccaacauggauuuggauugccugcucccccaggagugggugcagcacuucuaccaagaggcagcuccagcacaaucugauguggcucuauugagauuugugaauccagacacgggcaggguccuguuugagugcaaacuucauaaaucaggcuaugucacaguggcucauaccggccagcaugauuuaguuaucccccccaaugguuauuuuagguuugauuccuggguuaaucaauucuacacacuugcccccaugggaaauggaacggggcguagacgugcuuuauaa

SEQ ID NO: 4955 - RNA, 1623 nt, Artificial Sequence
  VP1__Norovirus__AFJ21391
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuguggagcgcgcccuugggcccugauuugaaucccuaccuuucccauuuggccagaauguacaauaguuaugcaggugguuuugaagugcagguaauccucgcggggaacgcguucaccgccggaaaaaucauauuugcagcagucccaccaaauuuuccaacugaaggcuugagccccagccaggucacuauguucccccauauaauaguagauguuaggcaacuggaaccuguguugaucccuuuacccgauguuaggaauaauuucuaucacuauaaccaaucaagugaccccaccaucaaauugauagcaauguuguauacaccacuuagggcuaauaaugcuggggacgaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccagcagugccuuuguuguucaaccacaaaauggcaggugcacgacugauggcgugcucuuagguacuacccaacugucuccugucaacaucugcaccuucagaggggaugucacccacauugcuggcacucaagaauacacaaugaaucuggccucccaaaacuggaacaauuaugacccaacagaagaaaucccagccccucuggggacuccagauuucguggguaagauccaaggcgugcucacccaaaccacaaggagggauggcucgacccgcggucacaaagccacagugagcacuggaaguguccacuucaccccaaagcugggcagaauucaauucuccacugauacaagcaaugauuuugaaacuggccaaaacacgagauucaccccagucgguguuguccaggaugguaguaccacccaccaaaaugaaccccaacaauggguacucccaaauuauucagguagagauagucacaaugugcaucuagccccugccguggcccccucuuuuccgggugagcaacuucuuuucuucagguccacuaugcccggaugcagcggguaucccaacauggauuuggacugucuacucccccaggagugggugcagcacuucuaccaagaggcagccccagcacaaucugauguggcucugcuaagauuugugaauccagauacagguaggguucuguuugaguguaagcuucauaaaucaggcuaugucacaguggcucacacuggccaacaugauuuaguuaucccccccaauggcuauuuuagauuugauuccugggucaaccaguucuacacacuugcccccaugggaaauggaacggggcguagacgugcauuauaa

SEQ ID NO: 4956 - RNA, 1623 nt, Artificial Sequence
  VP1__Norovirus__AFJ21392
augaagauggcgucgagugacgccaacccaucugauggguccacagccaaccucgucccagaggucaacaaugagguuauggcuuuggagcccguuguuggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguacacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguccaaccacaaaacggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaagggagauggcucgacccguggccacaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaauauggauuuggauugccuacucccccaggagugggugcagcacuucuaccaagaggcagcuccagcacaaucugauguggcccuauugagauuugugaauccagacacggguaggguccuguuugagugcaaacuucauaaaucaggcuaugucacaguggcucacaccggccagcaugauuuggucaucccccccaauggcuauuuuagguuugaugccuggguaaaucaauucuacacacuugcccccaugggaaauggaacggggcguaaacgugcuuuauaa

SEQ ID NO: 4957 - RNA, 1623 nt, Artificial Sequence
  VP1__Norovirus__AFJ21393
augaagauggcgucgaaugacgccaacccaucugauggguccgcagccaaccucgucccagaggucaacaaugagguuauggcuuuggagcccguugucggugccgcuaucgcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaggaugucuucacagucucuugucgaguucucacgaggccauccccugauuuugauuuuauauuuuuggugccacccacaguugagucgagaaccaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcacuacccaacugucuccugucaacaucugcaccuucagaggggaugucacccacauugcagguucucguaauuacacgaugaauuuggcuucucuaaauuggaacaauuaugacccaacagaagaaauuccagccccucuaggaacuccggauuucgugggaaagauccaaggugugcucacucaaaccacgaagggagaugguucgacccguggccauaaagcuacaguuuacacugggagugcccccuuuacuccaaagcugggcaguguacaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaaugguuauuuuagguuugauuccuggguuaaucaauucuacacacuugcccccaugggaaauggaacggggcguagacgugcuuuauaa

SEQ ID NO: 4958 - RNA, 1623 nt, Artificial Sequence
  VP1__Norovirus__AFJ21394
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuguggagcgcgcccuuaggcccugaucugaaucccuaccuaucucauuuggccagaauguauaaugguuaugcaggugguuuugaagugcaggugauccucgcgggaaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuugguaccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagacuucgugggaaagauccaaggugugcucacucaaaccacaaagggggauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagauacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 4959 - RNA, 1623 nt, Artificial Sequence
  VP1__Norovirus__AFJ21395
augaagauggcgucgaaugacgccaacccaucugauggguccgcagccaaccucgucccagaggucaacaaugagguuauggcuuuggagcccguugucggugccgcuaucgcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaggaugucuucacagucucuugucgaguucucacgaggccauccccugauuuugauuuuauauuuuuggugccacccacaguugagucgagaaccaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacgaugaauuuggcuucucuaaauuggaacaauuaugacccaacagaagaaauuccagccccucuaggaacuccggauuucgugggaaagauccaaggugugcucacucaaaccacgaagggagaugguucgacccguggccauaaagcuacaguuuacacugggagugcccccuuuacuccaaagcugggcaguguacaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaaugguuauuuuagguuugauuccuggguuaaucaauucuacacacuugcccccaugggaaauggaacggggcguagacgugcuuuauaa

SEQ ID NO: 4960 - RNA, 1623 nt, Artificial Sequence
  VP1__Norovirus__AFJ21396
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuguggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaaccaaaccauuuacugucccaaucuuaaccguugaagaaaugaccaauucaagauuccccaucccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauucaaggugugcucacucaaaccacaaagggagauggcucgacccguggccauaaagccacaguuuacacugggagugcccccuuuacuccaaagcugggcaguguucaauucaguacugauacagaaaaugauuuugaaacucaccaaaacacaaaauucaccccaguuggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagauacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 4961 - RNA, 1623 nt, Artificial Sequence
  VP1__Norovirus__AFJ21397
augaagauggcgucgagugacgccaacccaucugauggguccacagccaaccucgucccagaggucaacaaugagguuauggcuuuggagcccguuguuggagccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugacuugaaucccuaccuuucccauuuggccagaauguacaauaguuaugcaggugguuuugaagugcagguaauccucgcggggaacgcguucaccgccggaaaaaucauauuugcagcagucccaccaaauuucccaacugaaggcuugagccccagccagguuacuauguucccccauauaauaguagauguuaggcaacuggacccuguguugauccccuuacccgauguuaggaauaauuucuaucacuauaaucaaucaaaugaccccaccaucaaauugauagcaauguuguauacaccacuuagggcuaauaaugcuggggacgaugucuucacagucucuugucggguucucacgagaccaucccccgauuuugauuucauauuuuuagugccaccuacaguugagucaagaacuaaaccauucucugucccaauuuuaacuguugaggagaugaccaauucaagauuccccauuccuuuggaaaaguuguucacgggucccagcagugcuuuuguuguucaaccacaaaauggcaggugcacgacugauggcgugcuccuagguacuacccaacugucuccugucaacaucugcaccuucagaggggaugucacccacauugcagguacucaagaauacacaaugaaucuggccucccaaaacuggaacaauuaugacccaacagaagaaaucccagccccucugggaacuccagauuucguggguaagauccaaggcgugcucacccaaaccacacggggggauggcucgacccguggucacaaagccacagugagcacuggaaguguccacuucaccccaaagcugggcagaauucaauucuccacugauacaagcaaugauuuugaaacuggccaaaacacgagauucaccccaguugguguuguccaggaugguaguaccacccaccaaaaugaaccccaacaaugggugcucccaaauuauucagguagagauagucacaaugugcaccuagccccugcuguggcccccucuuuuccgggugagcaacuucuuuucuucagguccacuaugcccggaugcagcggguaucccaacaugaauuuggauugccuacucccccaggagugggugcagcacuucuaccaagaggcagccccagcacaaucugauguggcucugcuaagauuugugaauccagacacagguaggguucuguuugaguguaagcuucauaaaucaggcuaugucacaguggcucacacuggccaacaugauuuaguuaucccccccaauggcuauuuuagguuugauuccugggucaaccaauucuacacacuugcccccaugggaaauggaacggggcguagacgugcauuauaa

SEQ ID NO: 4962 - RNA, 1623 nt, Artificial Sequence
  VP1__Norovirus__AFJ21398
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucuuaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguccaaccacaaaauggcagaugcacgacugauggcgugcucuuaggcaccacccaacugucuccugucaacaucugcaccuucagaggggaugucacccacauugcaggcucucguaauuacacaaugaauuuggcuucccuaaauuggaacaauuaugacccaacagaagaaauuccagccccucuaggaacuccagauuucgugggaaagauccaaggugugcucacucaaaccacaaagggagauggcucgacccguggccauaaagcuacagucuacacugggagugcccccuuuacuccaaagcugggcaguguccaauucaguacugacacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggauguagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucauaccggccagcaugauuuggucauccccuccaaugguuauuuuagguuugauuccuggguuaaucaauucuacacacuugcccccaugggaaaugggacggggcguagacgugcuuuauaa

SEQ ID NO: 4963 - RNA, 1623 nt, Artificial Sequence
  VP1__Norovirus__AFJ21399
augaagauggcgucgaaugacgccagcccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggcgaaauauuguggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccagguuaccauguucccccacauaauaguagaugucaggcaauuggaaccuguguugauccccuugccugauguuaggaacaacuucuaucauuauaaucagucaaaugauucuaccauuaaauugauagcaaugcuguauacaccacuuagggcuaauaaugcuggggaagaugucuucacagucucuugucgaguccucacgaggccaucccccgauuuugauuuuauauuucuagugccacccacaguugagucaagaacuaaaccauuuacugucccaaucuuaacuguugaagaaaugacuaauucaagauuccccauuccuuuggaaaaguuguucacgggucccagcggugccuuuguuguucaaccacaaaauggcagaugcacgacugauggcgugcuccuaggcaccacccaacuguccccugucaacaucugcaccuucagaggggaugucacccacauugcagguucucguaacuacacaaugaauuuggcugcucugaauuggaacaauuaugacccaacagaagaaauuccagccccucuaggaaccccagauuucgugggaaagauccaaggugugcucacucaaaccacaaaggcagauggcucgacccguggucauaaagcuacagucuacacugggagugccgacuuuacuccaaagcugggcaguguucaauucaguacugauacagaaaaugauuuugaaacucaccaaaacacaaaauucaccccagucggugucauccaggaugguaacaccacccaccgaaaugaaccccaacaaugggugcucccaaguuauucagguagaaauguccauaauguacaccuagccccugcuguagcccccaccuuuccgggugaacaacuucuuuucuucagguccacuaugcccggaugcagcggguaucccaacauggauuuggauugccuacucccccaagagugggugcagcacuucuaccaagaggcagcuccagcacaaucugauguggcucuauugagauuugugaauccagacacggguaggguccuguuugagugcaaacuccauaaaucaggcuaugucacaguggcucacaccggccagcaugacuuggucaucccccccaauggcuauuuuagguuugauuccuggguuaaucaauucuacacacuugcccccaugggaaauggaacggggcguagacgugcuuuauaa

SEQ ID NO: 4964 - RNA, 1623 nt, Artificial Sequence
  VP1__Norovirus__AFJ21400
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucuuaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguccaaccacaaaauggcagaugcacaacugauggcgugcucuuaggcaccacccaacugucuccugucaacaucugcaccuucagaggggaugucacccacauugcaggcucucguaauuacacaaugaauuuggcuucccuaaauuggaacaauuaugacccaacagaagaaauuccagccccucuaggaacuccagauuucgugggaaagauccaaggugugcucacucaaaccacaaagggagauggcucgacccguggccauaaagcuacagucuacacugggagugcccccuuuacuccaaagcugggcaguguucaauucaguacugacacagaaaaugauuuugaaacacaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggauguagcggguaucccaacauggauuuggauugccuacucccccaggagugggugcagcacuucuaucaagaggcagcuccagcacaaucugauguggcucuauugagauuugugaauccagacacggguaggguccuguuugagugcaaacuucauaaaucaggcuaugucacaguggcucauaccggccagcaugauuuggucauccccuccaaugguuauuuuagguuugauuccuggguuaaucaauucuacacacuugcccccaugggaaaugggacggggcguagacgugcuuuauaa

SEQ ID NO: 4965 - RNA, 1623 nt, Artificial Sequence
  VP1__Norovirus__AFJ21401
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggccaauaaugcuggggaagaugucuucacagucucuugucgaguccucacgagaccauccccugauuuugauuuuauauuuuuggugccacccacaguugagucaagaacuaaaccauuuacugucccaaucuuaacuguugaagaaaugaccaauucaagauuccccauuccauuggaaaaguuguucacgggucccagcggcgccuuuguuguccaaccacaaaauggcaggugcacgacugauggcgugcucuuaggcaccacccaacuguccccugucaacaucugcaccuucagaggggaugucacccacauugcagguucucgugauuacacaaugaauuuggcaucucuaaauuggaacaauuaugacccaacagaagaaacuccagccccucugggaacuccagauuucgugggaaagauccaagguaugcucacucaaaccacaaagggagauggcucgacccguggccauaaagcuacaguuuacacugggagugcccccuuuacuccaaagcugggcaguguucgauucaguacugauacagaaaaugauuuugaaacucaccaaaacacaaaauucaccccagucggugucauccaggaugguagcaccacccaccgaaaugaaccccaacaaugggugcucccaaguuauucagguagagacguccauaauguacaccuagccccugcuguagcccccacuuuuccgggugaacaacuucuauucuucagguccacuaugcccggaugcaguggguaucccaacauggauuuggauugccuacucccccaggagugggugcagcacuucuaccaagaggcagcuccagcacaaucugauguggcccuauugagauuugugaauccagauacggguaggguccuguuugagugcaaacuucauaaaucaggcuaugucacaguggcucacaccggccagcaugauuugguuaucccccccaaugguuauuuuagguuugauuccugggucaaucaauucuacacacuugcccccaugggaaauggaacggggcguagacgugcucuauaa

SEQ ID NO: 4966 - RNA, 1623 nt, Artificial Sequence
  VP1__Norovirus__AFJ21402
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggucugagucccagccaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggccaauaaugcuggggaagaugucuucacagucucuugucgaguccucacgagaccauccccugauuuugauuuuauauuuuuggugccacccacaguugagucaagaacuaaaccauuuacugucccaaucuuaacuguugaagaaaugaccaauucaagauuccccauuccauuggaaaaguuguucacgggucccagcggcgccuuuguuguccaaccacaaaauggcaggugcacgacugauggcgugcucuuaggcaccacccaacuguccccugucaacaucugcaccuucagaggggaugucacccacauugcagguucucgugauuacacaaugaauuuggcaucucuaaauuggaacaauuaugacccaacagaagaaauuccagccccucugggaacuccagauuucgugggaaagauccaagguaugcucacucaaaccacaaagggagauggcucgacccguggccauaaagcuacaguuuacacugggagugcccccuuuacuccaaagcugggcaguguucgauucaguacugauacagaaaaugauuuugaaacucaccaaaacacaaaauucaccccagucggugucauccaggaugguagcaccacccaccgaaaugaaccccaacaaugggugcucccaaguuauucagguagagacguccauaauguacaccuagccccugcuguagcccccacuuuuccgggugaacaacuucuauucuucagguccacuaugcccggaugcaguggguaucccaacauggauuuggauugccuacucccccaggagugggugcagcacuucuaccaagaggcagcuccagcacaaucugauguggcccuauugagauuugugaauccagauacggguaggguccuguuugagugcaaacuucauaaaucaggcuaugucacaguggcucacaccggccagcaugauuugguuaucccccccaaugguuauuuuagguuugauuccugggucaaucaauucuacacacuugcccccaugggaaauggaacggggcguagacgugcucuauaa

SEQ ID NO: 4967 - RNA, 1623 nt, Artificial Sequence; identical to SEQ ID NO: 4966
  VP1__Norovirus__AFJ21403

SEQ ID NO: 4968 - RNA, 1623 nt, Artificial Sequence; identical to SEQ ID NO: 4966
  VP1__Norovirus__AFJ21404

SEQ ID NO: 4969 - RNA, 1623 nt, Artificial Sequence
  VP1__Norovirus__AFJ21405
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcaguuccaccaaauuuuccaacugaaggcuugagucccagccaggucacuauguucccccacauaauaguagauguuaggcaauuggaaccuguguugauccccuuaccugauguuaggaauaacuucuaucacuauaaccagucaaaugauucuaccauuaaauugauagcaaugcuauauacaccacuuagggccaauaaugccggggaugaugucuucacagucucuugucgaguccucacgaggccauccccugauuuugacuucauauuuuuggugccaccuacaguugagucaagaacuaagccauuuacugucccaaucuugacuguugaagaaaugaccaauucaagauuccccauuccuuuggaaaaguuguucacgggucccagcagugccuuuguuguucaaccacaaaauggcaggugcacgacugauggcgugcucuuaggcaccacccaacugucuccugucaacaucugcaccuucagaggggaugucacccacauugcggguucucguaauuacacaaugaauuuggccucucugaauuggaacaauuaugacccaacagaagaaauuccagccccccugggaacuccagauuucgugggaaagauccaaggugugcucacucaaaccacaaagggagauggcucgacccggggccauaaagcuacaguuuacacugggagugccgacuucacuccaaagcugggcaguguucaguuuaguacugauacagaaaaugauuuugaaacucaccaaaacacaaaauucaccccagucgguguuauccaggaugguagcaccacccaccgaaaugaaccccaacaaugggugcucccaaguuauucagguagaaauguccauaauguacaccuagccccugcuguagcccccaauuuuccgggugaacaacuucuuuucuucagguccacuaugcccggaugcagcggguaucccaacauggaucuggauugccuacucccccaggagugggugcagcacuucuaccaagaggcagcuccagcacaaucugauguggcucuauugagauuugugaauccagacacggguagggucuuguuugagugcaaacuucauaaaccaggcuaugucacaguggcucauaccggccaacaugauuuggucaucccccccaaugguuauuuuagguuugauuccuggguuaaucaguucuacacacuugcccccaugggaaauggagcggggcguagacgugcuuuauaa

SEQ ID NO: 4970 - RNA, 1623 nt, Artificial Sequence
  VP1__Norovirus__AFJ21406
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaauaucugcaccuucagaggggaugucacccauauuccaggcagucguaacuacacaaugaauuuggccucccaaaauuggaacaguuacgauccaacagaagaaaucccagccccccuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguauuucuaccaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 4971 - RNA, 1623 nt, Artificial Sequence
  VP1__Norovirus__AFJ21407
augaagauggcgucgagugacgccaacccaucugauggguccacagccaaccucgucccagaggucaauaaugagguuauggcuuuggagcccguuguuggugccgccauugcggcaccuguagcgggccaacaaaauguaauugaccccuggguuagaaacaacuuuguacaagccccugguggagaguuuacaguguccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucaccauguucccccacauaauaguagauguuaggcaauuggaaccuguguugauccccuuacccgauguuaggaauaauuucuaccauuauaaucaaucaaaugaccccaccaucaaauugauagcaauguuguauacaccacuuagggcuaauaaugcuggggacgaugucuucacaguuucuugucgaguucucacgagaccaucccccgauuuugauuucauauuucuagugccacccacaguugaaucaagaacuaaaccauucucugucccaauucuaacuguugaggagaugaccaauucaagguuccccauuccuuuggaaaaguuguucacgggccccaguagugccuuuguuguucaaccacaaaacggcaggugcacgacugauggcguccuccuagguacuacccaacugucuccugucaacaucugcaccuucagaggggaugucacccauauugcaggcagucauaacuacacaaugaaucuggcuucccaaaauuggaacaguuaugacccaacagaagaaaucccagccccucuaggaacuccagauuucguggggaagauucaaggugugcucacccaaaccacaaggacggauggcucuacccgcggccacaaagccacaguguacacugggagcaccgaauuuuccccaaaacuggguagaguucaauuugccacugacacaaacaaugauuuugaugcuaaccaaaacacaaaguucaccccagucgguguuauccaggauggugguacuacccaccgaaaugaaccccaacaaugggugcuuccaaguuacucaggcagaaauacucauaaugugcaccuggcccccgcuguagcucccacuuuuccgggugagcagcuccucuucuucagaucuaccaugcccggaugcagcggguaccccaacauggauuuggacugucugcucccccaggaaugggugcaguauuucuaccaggaggcagccccagcacaaucugauguggcucugcuaagauuugugaacccagacacagguaggguuuuguuugaguguaagcuucauaaaucgggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 4972 - RNA, 1623 nt, Artificial Sequence
  VP1__Norovirus__AFJ21409
augaagauggcgucgagugacgccaacccaucugauggguccacagccaaccucgucccagaggucaacaaugagguuauggcuuuggagcccguuguuggcgccgcuauugcggcaccuguagcgggccaacaaaauguaauugaccccuggauuagaaauaauuuuguacaagcuccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguuuccccauauaauaguagauguuaggcaauuggaaccuguguugauccccuuacccgauguuaggaauaauuucuaucacuacaaucaaucaaaugaccccaccaucaaauugauagcaauguuguauacaccacuuagggcuaauaaugcuggggacgaugucuucacaguuucuugucggguucucacgagaccaucccccgauuuugauuuuauauuuuuagugccacccacaguugagucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgacugauggcgugcuccuagguaccacccaacugucuccugucaacaucugcaccuucagaggggacgucacccauauuacaggcagucguaauuacacaaugaauuuggcuacucaaaacuggaacaguuaugacccaacagaagaaaucccagccccucuaggaacuccagauuucguggggaagauccaaggugugcucacccaaaccacaagggcagauggcucgacccgcggccacaaagcuacaguguacacugggagcgccgauuuugcuccaaaacuggguagaguucaauuugccacugacacagacaaugauuuugaugcuaaccaaaacacaaaauucaccccagucggugucauccaggauggugauacugcccaccgaaaugagccccaacaaugggugcucccaaguuacucaggcagaaauagucacaaugugcaccuggcccccgcuguagcccccacuuuuccgggugagcaacuccucuucuucagauccacuaugcccggaugcagcggguacccuaacauggauuuggacugucugcucccucaggaauggguacaguauuucuaucaagaggcagccccagcacaaucugauguggcucugcuaagauuugugaauccagacacagguaggguuuuguuugaguguaagcuucauaaaucaggcuauguuacaguggcucacaccggccaacaugauuugguuaucccccccaaugguuauuuuagauuugauuccugggucaaccaguucuacacacuugcccccaugggaaauggaacggggcguagacgugcuuuauaa

SEQ ID NO: 4973 - RNA, 1623 nt, Artificial Sequence
  VP1__Norovirus__AFJ21410
augaagauggcgucgagugacgccaacccaucugauggguccacagccaaccucgucccagaggucaauaaugagguuauggcuuuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuacgcaggugguuuugaagugcagguaauccucgcggggaacgcguucaccgccgggaaaaucguauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguauacaccacuuagggcuaauaaugcuggggacgaugucuucacaguuucuugucgaguucucacgagaccaucccccgauuuugauuucauauuucuagugccacccacaguugaaucaagaacuaaaccauucucugucccaauucuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauugcaggcagucauaacuacacaaugaaucuggcuucccaaaauuggaacaguuaugacccaacagaggaaaucccagccccucuaggaaccccagauuucguggggaagauucaaggugugcucacccaaaccacaaggacggauggcucgacccgcggccacaaagccacaguguacacugggagcgccgaauuuuccccaaaacuggguagaguucaauuugccacugacacaaacaaugauuuugaugcuaaccaaaacacaaaguucaccccagucggugucauccaggauggugguacuacccaccgaaaugaaccccaacaaugggugcuuccaaguuacucaggcagaaauacucauaaugugcaccuggcccccgcuguagcccccacuuuuccgggugagcagcuccucuucuucagaucuaccaugcccggaugcaguggguaccccaacauggauuuggacugucugcucccccaggaaugggugcaguauuucuaccaggaggcagccccagcacaaucugauguggcucugcuaagauuugugaacccagacacagguaggguuuuguuugaguguaagcuucauaaaucaggcuauguuacaguggcucacacuggccaacaugauuugguuauuccccccaaugguuauuuuagauuugauuccugggucaaccaguucuacacacuugcccccaugggaaaugggacggggcguagacgugcauuauaa

SEQ ID NO: 4974 - RNA, 1623 nt, Artificial Sequence
  VP1__Norovirus__AFJ21411
augaagauggcgucgagugacgccaacccaucugauggguccacagccaaccucgucccagaggucaauaaugagguuauggcuuuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuagguccugauuugaaucccuaccuuucccauuuggccagaauguacaaugguuaugcaggugguuuugaagugcagguaauccucgcggggaacgcguucaccgccgggaaaaucguauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguauacaccacuuagggcuaauaaugcuggggacgaugucuucacaguuucuugucgaguucucacgagaccaucccccgauuuugauuucauauuucuagugccaccuacaguugaaucaagaacuaaaccauucucugucccaauucuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauugcaggcagucauaacuacacaaugaaucuggcuucccaaaauuggaacaguuaugacccaacagaggaaaucccagccccucuaggaaccccagauuucguggggaagauucaaggugugcucacccaaaccacaaggacggauggcucgacccgcggccacaaagcuacaguguacacugggagcgccgaauuuuccccaaaacuggguagaguucaauuugccacugacacaaacaaugauuuugaugcuaaccaaaacacaaaguucaccccagucggugucauccaggauggugguaccacccaccgaaaugaaccccaacaaugggugcuuccaaguuacucaggcagaaauacucauaaugugcaccuggcccccgcuguagcccccacuuuuccgggugagcagcuccucuucuucagaucuaccaugcccggaugcagcggguaccccaacauggauuuggacugucugcucccccaggaaugggugcaguauuucuaccaggaggcagccccagcacaaucugauguggcucugcuaagauuugugaacccagacacagguaggguuuuguuugaguguaagcuucauaaaucaggcuauguuacaguggcucacacuggccaacaugauuugguuauuccccccaaugguuauuuuagauuugauuccugggucaaccaguucuacacacuugcccccaugggaaaugggacggggcguagacgugcauuauaa

SEQ ID NO: 4975 - RNA, 1623 nt, Artificial Sequence
  VP1__Norovirus__AFJ21413
augaagauggcgucgagugacgccaacccaucugauggguccacagccaaccucgucccagaggucaauaaugagguuauggcuuuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucguauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguauacaccacuuagggcuaauaaugcuggggacgaugucuucacaguuucuugucgaguucucacgagaccaucccccgauuuugauuucauauuucuagugccacccacaguugaaucaagaacuaaaccauucucugucccaauucuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauugcaggcagucauaacuacacaaugaaucuggcuucccaaaauuggaacaguuaugacccaacagaggaaaucccagccccucuaggaaccccagauuucguggggaagauucaaggugugcucacccaaaccacaaggacggauggcucgacccgcggccacaaagcuacaguguacacugggagcgccgaauuuuccccaaaacuggguagaguucaauuugccacugacacaaacaaugauuuugaugcuaaccaaaacacaaaguucaccccagucggugucauccaggauggugguacuacccaccgaaaugaaccccaacaaugggugcuuccaaguuacucaggcagaaauacucauaaugugcaccuggcccccgcuguagcccccacuuuuccgggugagcagcuccucuucuucagaucuaccaugcccggaugcagcggguaccccaacauggauuuggacugucugcucccccaggaaugggugcaguauuucuaccaggaggcagccccagcacaaucugauguggcucugcuaagauuugugaacccagacacagguaggguuuuguuugaguguaagcuucauaaaucaggcuauguuacaguggcucacacuggccaacaugauuugguuauuccccccaaugguuauuuuagauuugauuccugggucaaccaguucuacacacuugcccccaugggaaaugggacggggcguagacgugcauuauaa

SEQ ID NO: 4976 - RNA, 1623 nt, Artificial Sequence
  VP1__Norovirus__AFJ21414
augaagauggcgucgagugacgccaacccaucugauggguccacagccaaccucgucccagaggucaacaaugagguuauggcuuuggagcccguaguuggugcugccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaauuggaaccuguguugauucccuuacccgauguuaggaauaauuucuaccauuauaaucaaucaaaugaccccaccauuaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaauaucugcaccuucagaggggaugucacccauauuccaggcagucguaacuacacaaugaauuuggccucccaaaauuggaacaguuacgauccaacagaagaaaucccagccccccuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaucccaacauggauuuggacugucugcucccccaggaaugggugcaguauuucuaccaggaggcagccccagcacaaucugauguggcucuguuaagauuugugaauccagacacagguaggguuuuguuugaguguaagcuucacaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 4977 - RNA, 1623 nt, Artificial Sequence
  VP1__Norovirus__AFJ21415
augaagauggcgucgagugacgccaacccaucugauggguccacagccaaccucgucccagaggucaauaaugagguuauggcuuuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucguauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguauacaccacuuagggcuaauaaugcuggggacgaugucuucacaguuucuugucgaguucucacgagaccaucccccgauuuugauuucauauuucuagugccacccacaguugaaucaagaacuaaaccauucucugucccaauucuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauugcaggcagucauaacuacacaaugaaucuggcuucccaaaauuggaacaguuaugacccaacagaggaaaucccagccccucuaggaaccccagauuucguggggaagauucaaggugugcucacccaaaccacaaggacggauggcucgacccgcggccacaaagcuacaguguacacugggagcgccgaauuuuccccaaaacuggguagaguucaauuugccacugacacaaacaaugauuuugaugcuaaccaaaacacaaaguucaccccagucggugucauccaggauggugguacuacccaccgaaaugaaccccaacaaugggugcuuccaaguuacucaggcagaaauacucauaaugugcaccuggcccccgcuguagcccccacuuuuccgggugagcagcuccucuucuucagaucuaccaugcccggaugcagcggguaccccaacauggauuuggacugucugcucccccaggaaugggugcaguauuucuaccaggaggcagccccagcacaaucugauguggcucugcuaagauuugugaacccagacacagguaggguuuuguuugaguguaagcuucauaaaucaggcuauguuacaguggcucacacuggccaacaugauuugguuauuccccccaaugguuauuuuagauuugauuccugggucaaccaguucuacacacuugcccccaugggaaaugggacggggcguagacgugcauuauaa

SEQ ID NO: 4978 - RNA, 1623 nt, Artificial Sequence
  VP1__Norovirus__AFJ21416
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagcgccuuuguuguucaaccacaaaacggcaggugcacgacugauggcgugcuccuagguacuacccaacugucuccugucaauaucugcaccuucagaggggaugucacccauauuccaggcagucguaacuacacaaugaauuuggccucccaaaauuggaacaguuacgauccaacagaagaaaucccagccccccuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggauguagcggguaccccaacauggauuuggacugucugcucccccaggaaugggugcaguauuucuaccaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 4979 - RNA, 1623 nt, Artificial Sequence
  VP1__Norovirus__AFJ21417
augaagauggcgucgagugacgccaacccaucugauggguccacagccaaccucgucccagaggucaauaaugagguuauggcuuuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuucgaagugcagguaauccucgcggggaacgcguucaccgccgggaaaaucguauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguauacaccacuuagggcuaauaaugcuggggacgaugucuucacaguuucuugucgaguucucacgagaccaucccccgauuuugauuucauauuucuagugccacccacaguugaaucaagaacuaaaccauucucugucccaauucuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauugcaggcagucauaacuacacaaugaaucuggcuucccaaaauuggaacaguuaugacccaacagaggaaaucccagccccucuaggaaccccagauuucguggggaagauucaaggugugcucacccaaaccacaaggacggauggcucgacccgcggccacaaagcuacaguguacacugggagcgccgaauuuuccccaaaacuggguagaguucaauuugccacugacacaaacaaugauuuugaugcuaaccaaaacacaaaguucaccccagucggugucauccaggauggugguacuacccaccgaaaugaaccccaacaaugggugcuuccaaguuacucaggcagaaauacucauaaugugcaccuggcccccgcuguagcccccacuuuuccgggugagcagcuccucuucuucagaucuaccaugcccggaugcagcggguaccccaacauggauuuggacugucugcucccccaggaaugggugcaguauuucuaccaggaggcagccccagcacaaucugauguggcucugcuaagauuugugaacccagacacagguaggguuuuguuugaguguaagcuucauaaaucaggcuauguuacaguggcucacacuggccaacaugauuugguuauuccccccaaugguuauuuuagauuugauuccugggucaaccaguucuacacacuugcccccaugggaaaugggacggggcguagacgugcauuauaa

SEQ ID NO: 4980 - RNA, 1623 nt, Artificial Sequence
  VP1__Norovirus__AFJ21418
augaagauggcgucgagugacgccaacccaucugauggguccacagccaaccucgucccagaggucaauaaugagguuauggcuuuggagcccguuguuggugccgccauugcggcaccuguagcgggccaacaaaauauaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuacgcaggugguuuugaagugcagguaauccucgcggggaacgcguucaccgccgggaaaaucguauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguauacaccacuuagggcuaauaaugcuggggacgaugucuucacaguuucuugucgaguucucacgagaccaucccccgauuuugauuucauauuucuagugccacccacaguugaaucaagaacuaaaccauucucugucccaauucuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcacuuucagaggggaugucacccauauugcaggcagucauaacuacacaaugaaucuggcuucccaaaauuggaacaguuaugacccaacagaggaaaucccagccccucuaggaaccccagauuucguggggaagauucaaggugugcucacccaaaccacaaggacggauggcucgacccgcggccacaaagccacaguguacacugggagcgccgaauuuuccccaaaacuggguagaauucaauuugccacugacacaaacaaugauuuugaugcuaaccaaaacacaaaguucaccccagucggugucauccaggauggugguacuacccaccgaaaugaaccccaacaaugggugcuuccaaguuacucaggcagaaauacucauaaugugcaccuggcccccgcuguagcccccacuuuuccgggugagcagcuccucuucuucagaucuacccugcccggaugcaguggguaccccaacauggauuuggacugucugcucccccaggaaugggugcaguauuucuaccaggaggcagccccagcacaaucugauguggcucugcuaagauuugugaacccagacacagguaggguuuuguuugaguguaagcuucauaaaucaggcuauguuacaguggcucacacuggccaacaugauuugguuauuccccccaaugguuauuuuagauuugauuccugggucaaccaguucuacacacuugcccccaugggaaaugggacggggcguagacgugcauuauaa

SEQ ID NO: 4981 - RNA, 1623 nt, Artificial Sequence
  VP1__Norovirus__AFJ21419
augaagauggcgucgagugacgccaacccaucugauggguccacagccaaccucgucccagaggucaauaaugagguuauggcuuuggagcccguuguuggugccgccauugcggcaccuguagcgggccaacaaaauguaauugaccccuggauuagaaauaacuuuguacaagccccugguggagaguuuacaguauccccuagaaacgcuccaggugaaauacuauggagcgcgcccuuaggcccugauuugaaucccuaccuuucccauuuggccagaauguauaaugguuaugcaggugguuuugaagugcagguaauccucgcggggaacgcguucaccgccggaaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguauacaccacucagggcuaauaaugcuggggacgaugucuucacaguuucuugucgaguucucacgagaccaucccccgauuuugauuucauauuucuagugccacccacaguugaaucaagaacuaaaccauucucugucccaauucuaacuguugaggagaugaccaauucaagguuccccauuccuuuggaaaaguuguucacgggccccaguaguaccuuuguuguucaaccacaaaacggcaggugcacgacugauggcgugcuccuagguacuacccaacugucuccagucaacaucugcaccuucagaggggaugucacccauauugcaggcagucauaacuacacaaugaaucuggcuucccaaaauuggaacaguuaugacccaacagaagaaaucccagccccucuaggaacuccagauuucguggggaagauucaaggugugcucacccaaaccacaaggacggauggcucgacccgcggccacaaagcuacaguguacacugggagcgccgaauuuuccccaaaacuggguagaguucaauuugccacugacacaaacaaugacuuugaugcuaaccaaaacacaaaguucaccccagucgguguuauccaggauggugguacuacccaccgaaaugaaccccaacaaugggugcuuccaaguuacucaggcagaaauacucauaaugugcaccuggcccccgcuguagcccccacuuuuccgggugaacagcuccucuucuucagaucuaccaugcccggaugcagcggguaccccaacauggauuuggacugucugaucccccaggaaugggugcaguauuucuaccaggaggcagccccagcacaaucugauguggcucugcuaagauuugugaacccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 4982 - RNA, 1623 nt, Artificial Sequence; identical to SEQ ID NO: 4973
  VP1__Norovirus__AFJ21420

SEQ ID NO: 4983 - RNA, 1623 nt, Artificial Sequence
  VP1__Norovirus__AFJ21421
augaagauggcgucgagugacgccaacccaucugauggguccacagccaaccucgucccagaggucaauaaugagguuauggcuuuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucguauuugcaguagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguauacaccacuuagggcuaauaaugcuggggacgaugucuucacaguuucuugucgaguucucacgagaccaucccccgauuuugauuucauauuucuagugccacccacaguugaaucaagaacuaaaccauucucugucccaauucuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauugcaggcagucauaacuacacaaugaaucuggcuucccaaaauuggaacaguuaugacccaacagaggaaaucccagccccucuaggaaccccagauuucguggggaagauucaaggugugcucacccaaaccacaaggacggauggcucgacccgcggccacaaagcuacaguguacacugggagcgccgaauuuuccccaaaacuggguagaguucaauuugccacugacacaaacaaugauuuugaugcuaaccaaaacacaaaguucaccccagucggugucauccaggauggugguacuacccaccgaaaugaaccccaacaaugggugcuuccaaguuacucaggcagaaauacucauaaugugcaccuggcccccgcuguagcccccacuuuuccgggugagcagcuccucuucuucagaucuaccaugcccggaugcagcggguaccccaacauggauuuggacugucugcucccccaggaaugggugcaguauuucuaccaggaggcagccccagcacaaucugauguggcucugcuaagauuugugaacccagacacagguaggguuuuguuugaguguaagcuucauaaaucaggcuauguuacaguggcucacauuggccaacaugauuugguuauuccccccaaugguuauuuuagauuugauuccugggucaaccaguucuacacacuugcccccaugggaaaugggacggggcguagacgugcauuauaa

SEQ ID NO: 4984 - RNA, 1623 nt, Artificial Sequence; identical to SEQ ID NO: 4977
  VP1__Norovirus__AFJ21422

SEQ ID NO: 4985 - RNA, 1623 nt, Artificial Sequence
  VP1__Norovirus__AFJ21423
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguguccccuagaaacgcuccaggugaaauauuauggagcgcgcccuuaggcccugaucugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaauuggaaccuguguugauccccuuacccgauguuaggaauaauuucuaccauuacaaucaaucaaaugaccccaccaucaaauugauagcaauguuguacacaccacuuagggcuaauaaugcuggggacgaugucuucacaguuucuugccgaguucucacgagaccaucccccgauuuugauuucauauuuuuggugccacccacaguugaaucaagaacuaaaccauucucugucccaguuuuaacuguugaggagaugaccaauucaagguuccccauuccucuggaaaaguuguucacgggccccagcagugccuuuguuguucaaccacaaaauggcaggugcacgacugauggcgugcuccuagguaccacccaacuguccccugucaacaucugcaccuucagaggggaugucacccacauuucaggcagucguaacuacacaaugaauuuggccucccaaaauuggaacaguuacgacccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaacgaaccccaacaaugggugcucccaaguuacucaggcagaaauauucauaaugugcaccuggcccccgcuguagcccccacuuucccgggcgagcagcuccucuucuucagaucuacuaugcccggaugcaguggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 4986 - RNA, 1623 nt, Artificial Sequence
  VP1__Norovirus__AFJ21424
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuuccugucgaguucucacgagaccaucccccgauuuugauuucauauuucuggugccacccacaguugaaucaagaacuaaaccauucucugucccaguuuuaacuguugaggagaugaccaauucaagguuccccauuccuuuggaaaaguuguucacaggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgacccaacagaagaaaucccagccccucuaggaacuccagauuucguggggaagauucaaggugugcucacccaaacuacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauccauaaugugcaccuggcccccgcuguagcccccacuuucccgggcgaacagcuacucuucuucagaucuacuaugcccggaugcagcggguaccccaacauggauuuggacugucugcucccccaggaaugggugcaguauuucuaccaggaggcagccccagcacaaucugauguggcucuguuaagauuugugaauccagacacagguaggguuuuguuugaguguaagcuccauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 4987 - RNA, 1623 nt, Artificial Sequence
  VP1__Norovirus__AFJ21425
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuuccugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacaggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaauuacgacccaacagaagaaaucccagccccucuaggaacuccagauuucguggggaagauucaaggugugcucacccaaacuacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauccauaaugugcaccuggcccccgcuguagcccccacuuucccgggcgaacagcuccucuucuucagaucuacuaugcccggaugcagcggguaccccaacauggauuuggacugucugcucccccaggaaugggugcaguauuucuaccaggaggcagccccagcacaaucugauguggcucuguuaagauuugugaauccagacacagguaggguuuuguuugaguguaagcuccauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 4988 - RNA, 1623 nt, Artificial Sequence
  VP1__Norovirus__AFJ21426
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuuccugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacaggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgacccaacagaagaaaucccagccccucuaggaacuccagauuucguggggaagauucaaggugugcucacccaaacuacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauccauaaugugcaccuggcccccgcuguagcccccaccuucccgggcgaacagcuccucuucuucagaucuacuaugcccggaugcagcggguaccccaacauggauuuggacugucugcucccccaggaaugggugcaguauuucuaccaggaggcagccccagcacaaucugauguggcucuguuaagauuugugaauccagacacagguaggguuuuguuugaguguaagcuccauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 4989 - RNA, 1623 nt, Artificial Sequence
  VP1__Norovirus__AFJ21428
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuaucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucaaucaaaugacuccaccaucaaauugauagcaauguuguacacaccacuuagggcuaauaaugccggggaugaugucuuuacaguuucuugucgaguucucacgagaccaucccccgauuuugauuucauauuuuuggugccacccacaguugaaucaagaacuaaaccauucucugucccaguuuuaacuguugaggagaugaccaacucaagguuccccauuccuuuggaaaaauuguucacgggccccaguagugccuuuguuguucaaccacaaaacggcaggugcacgacugauggcgugcuccuagguacuacccaacugucuccugucaacaucugcaccuucagaggggaugucacccauauuucaggcagucguaacuacacaaugaauuuggccucccaaaauuggaacaguuacgauccagcagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauucgccacugacacagacaaugauuuugaaacuaaccaaaacacaaaguucaccccagucgguguuauccaggaugguaguacuaccccccgaaaugaaccccaacaaugggugcucccaaguuacucaggcagaaacauucauaaugugcaccuggcccccgcuguagcccccacuuucccgggcgagcagcuucucuucuucagaucuacuaugcccggaugcagcggguaccccaacauggacuuggacugucugcucccccaggaaugggugcaguacuucuaucaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 4990 - RNA, 1623 nt, Artificial Sequence; identical to SEQ ID NO: 4988
  VP1__Norovirus__AFJ21429

SEQ ID NO: 4991 - RNA, 1623 nt, Artificial Sequence
  VP1__Norovirus__AFJ21430
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuuccugucgaguucucacgagaccaucccccgauuuugauuucauauuuuuggugccacccacgguugaaucaagaacuaaaccauucucugucccaguuuuaacuguugaggagaugaccaauucaagguuccccauuccuuuggaaaaguuguucacaggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgacccaacagaagaaaucccagccccucuaggaacuccagauuucguggggaagauucaaggugugcucacccaaacuacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauccauaaugugcaccuggcccccgcuguagcccccaccuucccgggcgaacagcuccucuucuucagaucuacuaugcccggaugcagcggguaccccaacauggauuuggacugucugcucccccaggaaugggugcaguauuucuaccaggaggcagccccagcacaaucugauguggcucuguuaagauuugugaauccagacacagguaggguuuuguuugaguguaagcuccauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 4992 - RNA, 1623 nt, Artificial Sequence
  VP1__Norovirus__AFJ21431
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuguggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuuccugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacaggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgacccaacagaagaaaucccagccccucuaggaacuccagauuucguggggaagauucaaggugugcucacccaaacuacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauccauaaugugcaccuggcccccgcuguagcccccaccuucccgggcgaacagcuccucuucuucagaucuacuaugcccggaugcagcggguaccccaacauggauuuggacugucugcucccccaggaaugggugcaguauuucuaccaggaggcagccccagcacaaucugauguggcucuguuaagauuugugaauccagacacagguaggguuuuguuugaguguaagcuccauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 4993 - RNA, 1623 nt, Artificial Sequence
  VP1__Norovirus__AFJ21432
augaagauggcgucgagugacgccaacccaucugauggguccacagccaaccucgucccagaggucaacaaugagguuauggcuuuggagcccguaguuggugccgcuauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccacuauaaucaaucaaaugaccccaccaucaaauugauagcaauguuguacacaccacuuagggcuaauaaugccggggaugaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguuuacgggccccaguagugccuuuguuguucaaccacaaaacggcaggugcacgacugauggcgugcuccuagguacuacccaacuguccccugucaacaucugcaccuuuagaggggaugucacccauacuccaggcagucauaacuacacaaugaauuuggccucccaaaauuggaacaguuacgauccaacagaagaaaucccagccccucuaggaacuccagauuucguggggaagauucaaggugugcucacccaaacaacaaggacaaauggcucgacucgcggccacaaagcuacaguguacacugggagcgccgacuuuucuccaaaacuggguagaguucaauuugccacugacacagacaaugauuuugaaacuaaccaaaacacaaaguuuaccccagucgguguuauccaggaugguaguacuaccccccgaaaugaaccccaacaaugggugcucccaaguuacucaggcagaaacauucauaaugugcaccuggcccccgcuguggcccccacuuucccgggcgagcagcuccucuucuucagaucuacuaugcccggaugcagcggguaccccaacauggauuuggacugccugcucccccaggaaugggugcaguacuucuaccaggaggcagccccagcacaaucugacguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 4994 - RNA, 1623 nt, Artificial Sequence
  VP1__Norovirus__AFJ21433
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggucugagccccagccaggucacuauguucccccauauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuuccugucgaguucucacgagaccaucccccgauuuugauuucauauuuuuggugccacccacaguugaaucaagaacuaaaccauucucugucccaguuuuaacuguucaggagaugaccaauucaagguuccccauuccuuuggaaaaguuguucacaggccccaguagugccuuuguuguucaaccacaaaacggcaggugcacgacugauggcgugcuccuagguacuacccaacugucuccugucaacaucugcaccuucagaggggaugucacccauauuccagguagucguaacuacacaaugaauuuggccucccaaaauuggaacaguuacgacccaacagaagaaaucccagccccucuaggaacuccagauuucguggggaagauucaaggugugcucacccaaacuacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauccauaaugugcaccuggcccccgcuguagcccccaccuucccgggcgaacagcuccucuucuucagaucuacuaugcccggaugcagcggguaccccaacauggauuuggacugucugcucccccaggaaugggugcaguauuucuaccaggaggcagccccagcacaaucugauguggcucuguuaagauuugugaauccagacacagguaggguuuuguuugaguguaagcuccauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 4995 - RNA, 1623 nt, Artificial Sequence
  VP1__Norovirus__AFJ21434
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuaucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucaaucaaaugacuccaccaucaaauugauagcaauguuguacacaccacuuagggcuaauaaugccggggaugaugucuuuacaguuucuugucgaguucucacgagaccaucccccgauuuugauuucauauuuuuggugccacccacaguugaaucaagaacuaaaccauucucugucccaguuuuaacuguugaggagaugaccaacucaagguuccccauuccuuuggaaaaauuguucacgggccccaguagugccuuuguuguucaaccacaaaacggcaggugcacgacugauggcgugcuccuagguacuacccaacugucuccugucaacaucugcaccuucagaggggaugucacucauauuucaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgauuuuucuccaaaacuggguagaguucaauucgccacugacacagacaaugauuuugaaacuaaccaaaacacaaaguucaccccagucgguguuauccaggaugguaguacuaccccccgaaaugaaccccaacaaugggugcucccaaguuacucaggcagaaacauucauaaugugcaccuggcccccgcuguagcccccacuuucccgggcgagcagcuucucuucuucagaucuacuaugcccggaugcagcggguaccccaacauggacuuggacugucugcucccccaggaaugggugcaguacuucuaucaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 4996 - RNA, 1623 nt, Artificial Sequence
  VP1__Norovirus__AFJ21436
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggucugagccccagccaggucacuauguucccccauauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuuccugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacaggccccaguagugccuuuguuguucaaccacaaaacggcaggugcacgacugauggcgugcuccuagguacuacccaacugucuccugucaacaucugcaccuucagaggggaugucacccauauuccagguagucguaacuacacaaugaauuuggccucccaaaauuggaacaguuacgacccaacagaagaaaucccagccccucuaggaacuccagauuucguggggaagauucaaggugugcucacccaaacuacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauccauaaugugcaccuggcccccgcuguagcccccaccuucccgggcgaacagcuccucuucuucagaucuacuaugcccggaugcagcggguaccccaacauggauuuggacugucugcucccccaggaaugggugcaguauuucuaccaggaggcagccccagcacaaucugauguggcucuguuaagauuugugaauccagacacagguaggguuuuguuugaguguaagcuccauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 4997 - RNA, 1623 nt, Artificial Sequence
  VP1__Norovirus__AFJ21437
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuaucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucaaucaaaugacuccaccaucaaauugauagcaauguuguacacaccacuuagggcuaauaaugccggggaugaugucuuuacaguuucuugucgaguucucacgagaccaucccccgauuuugauuucauauuuuuggugccacccacaguugaaucaagaacuaaaccauucucugucccaguuuuaacuguugaggagaugaccaacucaagguuccccauuccuuuggaaaaauuguucacgggccccaguagugccuuuguuguucaaccacaaaacggcaggugcacgacugauggcgugcuccuagguacuacccaacugucuccugucaacaucugcaccuucagaggggaugucacccauauuucaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgauuuuucuccaaaacuggguagaguucaauucgccacugacacagacaaugauuuugaaacuaaccaaaacacaaaguucaccccagucgguguuauccaggaugguaguacuaccccccgaaaugaaccccaacaaugggugcucccaaguuacucaggcagaaacauucauaaugugcaccuggcccccgcuguagcccccacuuucccgggcgagcagcuucucuucuucagaucuacuaugcccggaugcagcggguaccccaacauggacuuggacugucugcucccccaggaaugggugcaguacuucuaucaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 4998 - RNA, 1623 nt, Artificial Sequence
  VP1__Norovirus__AFJ21438
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuuccugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacaggccccaguagugccuuuguuguucaaccacaaaacggcaggugcacgaccgauggcgugcuccuagguacuacccaacugucuccugucaacaucugcaccuucagaggggaugucacccauauuccaggcagucguaacuacacaaugaauuuggccucccaaaauuggaacaguuacgacccaacagaagaaaucccagccccucuaggaacuccagauuucguggggaagauucaaggugugcucacccaaacuacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauccauaaugugcaccuggcccccgcuguagcccccacuuucccgggcgaacagcuccucuucuucagaucuaccaugcccggaugcagcggguaccccaacauggauuuggacugucugcucccccaggaaugggugcaguauuucuaccaggaggcagccccagcacaaucugauguggcucuguuaagauuugugaauccagacacagguaggguuuuguuugaguguaagcuccauaaaucaggcuauguuacaguggcucacauuggccaguaugauuugguuaucccccccaaugguuauuuuagauuugauuccugggucaaccaguucuacacacuugcccccaugggaaaugggacggggcguagacgugcauuauaa

SEQ ID NO: 4999 - RNA, 1623 nt, Artificial Sequence
  VP1__Norovirus__AFJ21439
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucagucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacgguagaugcacgacugauggcgugcuccuagguacuacccaacugucuccugucaacaucugcaccuuuagaggggaugucacccauauuucaggcagccguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguaggguucaauuugccacugacacagacaaugauuuugaaacuaaccaaaacacaaaguucaccccagucgguguuauccaggaugguaguacuaccccccgaaaugaaccccaacaaugggugcuaccaaguuacucagguagaaacauucauaaugugcaccuggcccccgcuguagcccccacuuucccgggcgagcagcuccucuucuucagaucuaccaugcccggaugcagcggguaccccaacauggauuuggacugucuacucccccaggaaugggugcaguauuucuaccaggaggcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacgugcauuauaa

SEQ ID NO: 5000 - RNA, 1623 nt, Artificial Sequence
  VP1__Norovirus__AFJ21440
augaagauggcgucgagugacgccaacccaucugauggauccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcaggugauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuuuauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaagggcaaauggcucgacccgcggccacaaagcuacaguguacacugggagcgccgacuuuucuccaaaacuggguagaguucaauuugccacugacacagacaaugauuuugaaacuaaccaaaacacaaaguucaccccaguugguguuauccaggaugguaguaccaccccccgaaaugaaccccaacaaugggugcucccaaguuacucagguagaaacauucacaaugugcaccuggcccccgcuguagcccccacuuucccgggcgagcagcuccucuucuuuagaucuacuaugcccggaugcagcggguaccccaacauggacuuggacugucugcuaccccaggaaugggugcaguauuucuaccaggaggcagccccagcacaaucugauguggcucugcuaagauuugugaauccggacacagguaggguuuuguuugaguguaagcuucauaaaucaggcuauguuacaguagcucacacuggccaacaugauuugguuaucccccccaaugguuauuuuagauuugauuccugggucaaccaguucuacacacuugcccccaugggaaaugggacggggcguaggcgugcauuauaa

SEQ ID NO: 5001 - RNA, 1623 nt, Artificial Sequence
  VP1__Norovirus__AFJ21441
augaagauggcgucgagugacgccaacccaucugauggguccacagccaaccucgucccagaggucaacacugagguuauggcuuuggagcccguaguuggugccgccauugcggcacccguagcgggccaacaaaauguaauugaccccuggauuagaaacaauuuuguacaagccccugguggagaguuuacaguauccccuagaaacgcuccaggugaaauauuauggagcgcgccccuaggcccugaucugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaauuggaaccuguguugauccccuuacccgauguuaggaauaauuucuaccauuacaaucaaucaaaugacccuaccaucaaauugauagcaauguuguacacaccacuuagggcuaauaaugcuggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccagcagugccuuuguuguucaaccacaaaauggcaggugcacgacugauggcgugcuccuagguacuacccaacuguccccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuauucaggcaggaacauucauaaugugcaccuggcccccgcuguagcccccacuuucccgggcgagcagcuccucuucuucagaucuacuaugcccggaugcagcggguaccccaacauggauuuggacugucugcucccccaggaauggguacaguacuucuaccaggaggcagccccagcacaaucugaugcggcucuguuaagauuugugaauccagacacagguaggguuuuguuugaguguaagcuucauaaaucaggcuaugucacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 5002 - RNA, 1623 nt, Artificial Sequence
  VP1__Norovirus__AFJ21442
augaagauggcgucgaaugacgccaacccaucugauggguccgcagccaaccucgucccagaggucaacaaugagguuauggcuuuggagccuguuguuggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucccauuuggccagaauguauaaugguuaugcaggugguuuugaagugcaggugauccucgcggggaacgcguucaccgccgggaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaccagucaaaugauucuacuauuaaauugauagcaaugcuguauacaccacuuagggccaauaaugccggggaugaugucuucacagucucuugucgaguccucacgaggccauccccugauuuugacuucauauuuuuggugccacccacaguugagucaagaacuaagucauuuacugucccaaucuugacuguugaagaaaugacuaauucaagauuccccauuccuuuggaaaaauuguucacgggucccagcagugccuuuguuguucaaccacaaaacgguagaugcacgacugauggcgugcucuuaggcaccacccaacugucuccugucaacaucugcaccuucagaggggaugucacccacauugcugguucucgcaauuacacaaugaauuuggccucucuaaauuggaacaacuaugauccaacagaagaaauuccagccccucuggggacuccagauuucguggggaagauccaaggugugcucacucaaaccacaaagggagauggcucgacccggggccauaaagcuacaguuuacacugggagugccgacuucacuccaaagcuggguaguguucaauuugguacugauacggacaaugauuuugaaacucaccaaaacacaaaauucaccccagucggugucauccaggaugguagcaccacccaccguaaugaaccccaacaaugggugcucccaaguuauucagguagaaauguccauaauguacaccuagccccugcuguagcccccaauuuuccgggugaacaacuucuuuucuucagguccacuaugcccggaugcagcggguaucccaacauggacuuggauugccuacucccccaggagugggugcagcacuucuaccaagaggcagcuccagcacaaucugauguggcuuuauugagauuugugaauccagacacggguaggguccuguuugaaugcaaacuucauaaaucaggcuaugucacaguggcucacacuggucaacaugaucuggucaucccccccaaugguuauuuuagguuugauuccuggguuaaucaguucuacacacuugcccccaugggaaauggagcggggcguaaacgugcuuuauaa

SEQ ID NO: 5003 - RNA, 1623 nt, Artificial Sequence
  VP1__Norovirus__AFJ21443
augaagauggcgucgagugacgccaacccaucugauggguccacagccaaccucgucccagaggucaacaaugagguuauggcuuuggagcccguaguuggugccgcuauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacaugauaguagauguuaggcaauuggaaccuguguugauccccuuacccgauguuaggaauaauuucuaccacuauaaucaaucaaaugaccccaccaucaaauugauagcaauguuguacacaccacuuagggcuaauaaugccggggaugaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguuuacgggccccaguagugccuuuguuguucaaccacaaaacggcaggugcacgacugauggcgugcuccuagguacuacccaacuguccccugucaacaucugcaccuucagaggggaugucacccauacuccaggcagucauaacuacacaaugaauuuggccucccaaaauuggaacaguuacgauccaacagaagaaaucccagccccucuaggaacuccagauuucguggggaagauucaaggugugcucacccaaacaacaaggacaaauggcucgacucgcggccacaaagcuacaguguacacugggagcgccgacuuuucuccaaaacuggguagaguucaauuugccacugacacagacaaugauuuugaaacuaaccaaaacacaaaguuuaccccagucgguguuauccaggaugguaguacuaccccccgaaaugaaccccaacaaugggugcucccaaguuacucaggcagaaacauucauaaugugcaccuggcccccgcuguggcccccacuuucccgggcgagcagcuccucuucuucagaucuacuaugcccggaugcagcggguaccccaacauggauuuggacugccugcucccccaggaaugggugcaguacuucuaccaggaggcagccccagcacaaucugacguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 5004 - RNA, 1623 nt, Artificial Sequence
  VP1__Norovirus__AFJ21444
augaagauggcgucgagugacgccaacccaucugauggguccacagccaaccucgucccagaggucaauaaugagguuauggcuuuggagcccguuguuggugccgccauugcggcaccuguagcgggccaacaaaauguaauugaccccuggauuagaaauaacuuuguacaagccccugguggagaguuuacaguauccccuagaaacgcuccaggugaaauacuauggagcgcgcccuuagguccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucaccauguucccccacauaauaguagauguuaggcaauuggaaccuguguugauccccuuacccgauguuaggaauaauuucuaccauuauaaucaaucaaaugaccccaccaucaaauugauagcaauguuguauacaccacuuagggcuaauaaugcuggggacgaugucuucacaguuucuugucgaguucucacgagaccaucccccgauuuugauuucauauuucuagugccacccacaguugaaucaagaacuaaaccauucucugucccaauucuaacuguugaggagaugaccaauucaagguuccccauuccuuuggaaaaguuguucacgggccccaguagugccuuuguuguucaaccacaaaacggcaggugcacgacugauggcguccuccuagguacuacccaauugucuccugucaacaucugcaccuucagaggggaugucacccacacugcaggcagucauaacuacacaaugaaucuggcuucccaaaauuggaacaguuaugacccaacagaagaaaucccagccccucuaggaacuccagauuucguggggaagauccaagguguacucacccaaaccacaagggcggauggcucuacccgcggccacaaagccacaguguacacugggagcgccgaauuuuccccaaaacuggguagaguucaauuugccacugacacagacaaugauuuugaugcuaaccaaaacacaaaguucaccccagucgguguuauccaggauggugguacuacccaccgaaaugaaccccaacaaugggugcuuccaaguuacucaggcagaaauacucauaaugugcaccuggcccccgcuguagcucccacuuuuccgggugagcagcuccucuucuucagaucuaccaugcccggaugcagcggguaccccaacauggauuuggacugucugcucccccaggaaugggugcaguauuucuaccaggaggcagccccagcacaaucugauguggcucugcuaagauuugugaacccagacacagguaggguuuuguuugaguguaagcuucauaaaucgggcuauguuacaguggcucacacuggccaacaugauuugguuaucccccccaaugguuauuuuagauucgauuccugggucaaucaguucuacacacuugcccccaugggaaaugggacggggcguagacgugcauuauaa

SEQ ID NO: 5005 - RNA, 1623 nt, Artificial Sequence
  VP1__Norovirus__AFJ21445
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuuccugucgaguucucacgagaccaucccccgauuuugauuuuauauuuuuggugccacccacaguugaaucaagaacuaaaccauucucugucccaguuuuaacuguugaggagaugaccaauucaagguuccccauuccuuuggaaaaguuguucacaggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgacccaacagaagaaaucccagccccucuaggaacuccagauuucguggggaagauucaaggugugcucacccaaacuacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauccauaaugugcaccuggcccccgcuguagcccccacuuucccgggcgaacagcuccucuucuucagaucuacuaugcccggaugcagcggguaccccaacauggauuuggacugucugcucccccaggaaugggugcaauauuucuaccaggaggcagccccagcacaaucugauguggcucuguuaagauuugugaauccagacacagguaggguuuuguuugaguguaagcuccauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 5006 - RNA, 1623 nt, Artificial Sequence
  VP1__Norovirus__AFJ21446
augaagauggcgucgagugacgccaacccaucugauggguccacagccaaccucgucccagaggucaacaaugagguuauggcucuggagcccguaguuggugccgcuauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggucugagccccagccaggucacuauguucccccauauaauaguagauguuaggcaauuggaaccuguguugauccccuuacccgauguuaggaauaauuucuaccacuauaaucaaucaaaugaccccaccaucaaauugauagcaauguuguacacaccacuuagggcuaauaaugccggggaugaugucuucacaguuucuugucgaguucucacgagaccaucccccgauuuugauuuuauauuuuuggugccacccacaguugaaucaagaacuaaaccauucucugucccaguuuuaacuguugaggagaugaccaauucaagguuccccguuccuuuggaaaaguuguuuacgggccccaguagugccuuuguuguucaaccacaaaacggcaggugcacgacugauggcgugcuccuagguacuacccaacuguccccugucaacaucugcaccuucagaggggaugucacccauauuccaggcagucguaacuacacaaugaauuuagccucccaaaauuggaacaguuacgauccaacagaagaaaucccagccccucuaggaacuccagauuucguggggaagauucaaggugugcucacccaaacaacaaggacaaauggcucgacucgcggccacaaagcuacaguguacacugggagcgccgacuuuucuccaaaacuggguagaguucaauuugccacugacacagacaaugauuuugaaacuaaccaaaacacaaaguuuaccccagucgguguuauccaggaugguaguacuaccccccgaaaugaaccccaacaaugggugcucccaaguuacucaggcaggaacauucauaaugugcaccuggcccccgcuguggcccccacuuucccgggcgagcagcuucucuucuucagaucuacuaugcccggaugcagcggguaccccaacauggauuuggacugccugcucccccaggaaugggugcaguacuucuaccaggaggcagccccagcacaaucugacguggcucuguuaagauuugugaauccagacacagguaggguuuuguuugaguguaagcuucauaaaucaggcuaugucacaguggcucacacuggccaacaugauuugguuaucccccccaaugguuauuuuagauuugauuccuggguuaaccaguucuacacacuugcccccaugggaaaugggacggggcguaggcgugcauuauaa

SEQ ID NO: 5007 - RNA, 1623 nt, Artificial Sequence
  VP1__Norovirus__AFJ21448
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaauuggaaccuguguugauucccuuacccgauguuaggaacaauuucuaccauuauaaucaaucaaaugaccccaccaucaaauugauagcaauguuguacacaccacuuagggcuaauaaugccggggacgaugucuucacaguuuccugucggguucucacgagaccaucccccgacuuugauuucauauuuuuggugccacccacaguugaaucaagaacuaaaccauucucugucccaguuuuaacuguugaggagaugaccaauucaagguuccccauuccuuuggaaaaguuguucacaggccccaguagugccuuuguuguucaaccacaaaacggcaggugcacgacugauggcgugcuccuagguacuacccaacugucuccugucaacaucugcaccuucagaggggaugucacccauaucccaggcagucguaacuacacaaugaauuuggccucccaaaauuggaacaguuacgacccaacagaagaaaucccagccccucuaggaacuccagauuucguggggaagauucaaggugugcucacccaaacuacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcaggaacauccauaaugugcaccuggcccccgcuguagcccccacuuucccgggcgaacagcuccucuucuucagaucuacuaugcccggaugcagcggguaccccaacauggauuuggacugucugcucccccaggaaugggugcaguauuucuaccaggaggcagccccagcacaaucugauguggcucuguuaagauuugugaauccagacacagguaggguuuuguuugaguguaagcuccauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 5008 - RNA, 1623 nt, Artificial Sequence
  VP1__Norovirus__AFJ21451
augaagauggcgucgaaugacgccaacccaucugauggguccgcagccaaccucgucccagaggucaacaaugagguuauggcuuuggagcccguugucggugccgcuauugcggcgcccguagcgggccaacaaaauguaauugaccccuggauuagaaauaauuuuguacaagccccugguggggaguucacaguauccccuagaaacgcuccaggugaaacauuauggagcgcgcccuuaggcccugaccugaaucccuaccuaucucauuuggccagaauguauaaugguuaugcaggugguuuugaagugcaagugauccucgcggggaacgcguucaccgccggaaaaauuauauuugcagcagucccaccaaauuuuccaacugaaggcuugagucccagccaggucacuauguucccccauauaauaguagauguuagacaauuggaaccuguguugauccccuuaccugauguuaggaauaacuucuaucacuauaaucagucaaaugauucuaccauuaaauugauagcaaugcuguauacaccacuuagggccaauaaugccggggaugaugucuucacagucucuugucgaguccucacgaggccauccccugauuuugauuucauauuuuuggugccaccuacaguugagucaagaaccaagccauuuacugucccaaucuugacuguugaagaaaugaccaauucaagauuccccauuccuuuggaaaaauuguucacgggucccagcagugccuuuguuguucaaccacaaaauggcaggugcacgacugauggcgugcucuuaggcaccacccaacugucuccugucaacaucugcaccuucagaggggaugucacccacauugcggguucucgcaauuacacaaugaauuuggccucucuaaauuggaacaauuaugacccaacagaagaaaucccagccccucugggaacuccagauuucgugggaaagauccaagguaugcucacucaaaccacacagggagauggcucgacccggggccauaaagccacaguuuacacugggagugccgacuucacuccaaagcugggcaguguucaauuugcuacugauacagaaaaugauuuugaaacucaccaaaauacaaaauucaccccagucggugucauccaggaugguagcaccacccaccgaaaugaaccccaacaaugggcgcucccaaguuauucagguagaagugcccauaaugugcaccuagccccugcuguagcccccaauuuuccgggugaacaacuucucuucuucagguccacuaugcccggaugcagcggguaucccaacauggauuuggauugccuacucccccaggagugggugcagcacuucuaccaagaggcagcuccagcgcaaucugauguggcucuauugagauuugugaauccagacacggguagggucuuguuugagugcaaacuucauaaaucaggcuaugucacaguggcucacaccggccaacaugauuugguuaucccccccaaugguuauuuuagguuugauuccuggguuaaucaguucuacacacuugcucccaugggaaauggaacggggcguagacgugcuuuauaa

SEQ ID NO: 5009 - RNA, 1623 nt, Artificial Sequence
  VP1__Norovirus__AFJ21454
augaagauggcgucgagugacgccaauccaucugauggguccacagccaaccucgucccagaggucaacaaugagguuauggcucuggagcccguaguuggugccgcuauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaccccuaccuuucccauuuggccagaauguacaaugguuaugcaggugguuuugaagugcagguaauccucgcggggaacgcguucaccgccgggaaaaucauauuugcagcagucccaccaaauuucccaacugaaggucugagccccagccaggucacuauguucccccauauaauaguagauguuaggcaauuggaaccuguguugauucccuuacccgauguuaggaauaauuucuaccacuauaaucaaucaaaugaccccaccaucaaacugauagcaauguuguacacaccacuuagggcuaauaaugccggggaugaugucuucacaguuucuugucgaguucucacgagaccaucccccgauuuugauuuuauauuuuuggugccacccacaguugaaucaagaacuaaaccauucucugucccaguuuuaacuguugaggagaugaccaauucaagguuccccauuccuuuggaaaaguuguuuacgggccccaguagugccuuuguuguucaaccacaaaacggcaggugcacgacugauggcgugcuccuagguacuacccaacuguccccugucaacaucugcaccuucagaggggaugucacccauauuccaagcagucguaacuacacaaugaauuuggccucccaaaauuggaacaguuacgauccaacagaagagaucccagccccucuaggaacuccagauuucguggggaagauucaaggugugcucacccaaacaacaaggacagauggcucgacucgcggccacaaagcuacaguguacacugggagcgccgacuuuucuccaaaacuggguagaguucaauuugccacugacacagacaaugauuuugaaacuaaccaaaacacaaaguuuaccccagucgguguuauccaggaugguaguacuacccaccgaaaugaaccccaacaaugggugcucccaaguuacucaggcagaaacauucauaaugugcaccuggcccccgcuguggcccccacuuucccgggcgagcagcuucucuucuucagaucuacuaugcccggaugcagcggguaccccaacauggauuuggacugccugcucccccaggaaugggugcaguacuucuaccaggaggcagccccagcacaaucugacguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguaggcgugcguuauaa

SEQ ID NO: 5010 - RNA, 1623 nt, Artificial Sequence
  VP1__Norovirus__AFL70023
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggccccgaucugaaucccuaccuugcucauuuggccagaauguacaauggcuaugcagguggcuuugaagugcagguaauccuugcggggaaugcguucaccgccggaaaaaucauauuugcagcagucccaccaaauuucccaacugaaggcuugagccccagccaggucacuauguucccccauauaguaguagauguuaggcaacuggaaccuguguugauccccuuaccugauguugggaacaauuucuaucauuacaaccaaucaaaugaccccaccauuaaacugauagcaaugcuguacacaccacuuagggcuaauaaugcuggggaagaugucuuuacagucucuugucgaguccucacgaggccaucucccgauuuugauuucauauuuuuggugccacccacaguugagucaagaacuaaaccauucaccgucccaaucuuaacuguugaggaaaugaccaauucaagauuccccauuccuuuggaaaaguuguucacggguccuagcggugccuuuguuguucaaccacaaaauggcaggugcacgacugauggcgugcuuuuaggcacuacccaacugucuccugucaacaucugcaccuucagaggggaugucacccacauugcaggcacucauaauuacacaaugaauuuggcuucucaaaauuggaacaauuaugacccaacagaagaaaucccagccccucuggggaccccagauuucgugggaaggauccaaggcaugcucacccaaacuacaaggggagauggcucuacccgcggccacaaagcuacagugagcacuggggauguccacuucaccccaaagcugggcaguauucaguucaacacugauacaaacaaugauuuugaaacuggccaaaacacgaaauucaccccagucgguguuguccaggaugguaauggugcccaccaaaaugaaccucaacaaugggugcucccaagcuacucagguagaacuggucauaauguacacuuagcccccgccguagcccccacuuuuccgggugagcaacuucuuuucuucagguccacuaugcccgggugcagcggguacccuaacaugaauuuggauugucuacucccccaagaaugggugcagcacuucuaccaagaggcagccccagcacaaucugauguggcucugcuaagauuugugaauccagacacagguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacgugcauuauaa

SEQ ID NO: 5011 - RNA, 1653 nt, Artificial Sequence
  VP1__Norovirus__AFN06724
augaagauggcgucgaaugacgcugcuccaucgaaugauggugcugccaaccucguaccagaggccaacaaugagguuauggcacuugaaccgguggugggagccucaaucgcagcuccuguugucggucagcaaaauauaauugaccccuggauuagagaaaauuuuguccaagcaccacagggcgaguucacugucucaccaaggaauucgccuggugagaugcuuuuaaaucuugaguugggcccagaacuuaaucccuauuuaagucauuugucccgcauguacaacggauaugcugguggcaugcagguucaggugguccuagcugggaaugcguucacagcugggaaaaucaucuuugccgccguaccaccacauuucccuguagaaaacaucagugcagcccagauaacuauguguccccaugugauuguugaugugagacaacuugaaccagugcuucugccccucccugauauaaggaacagguucuuccauuacaaccaagagagcaccccccggaugaggcuuauagccaugcuuuauacaccucugagggccaauucuggugaggacguguucacuguguccugcaggguuuugacucgucccgcuccagauuuugaguucacauuuuuagugccaccaacuguugaaucaaagacaaaaccuuucacuuugccuauucugacccuuggugaguugucuaauucucgcuuuccggcugcuauagauaugcuuuauacugauccuaaugaaucaauaguuguacaaccccaaaaugguaggugcacucuugauggcaccuugcaaggcacaacacaauugguccccacacaaauuugugccuuuagaggcacucugaucagccagaccgcgagagcggccgacucaacagauuccccccagagagcccgugaucauccauuacacguccaggucaagaaccuagacggcacacaauacgacccaacggaugauauaccugcaguccugggggcuauugacuucaaagguacaguuuuuggaguggccagucaaagggaugucucugggcaacaagaacagggccacuaugccacccgagcccaugaagcacacauugauacaacugacccaaaguaugcacccaaauuaggcacaauccuuauuaaaucugaaucuaaugauuuuacuacaaaucagcccauuagguucacuccggugggcaugggugacaacaauuggagacagugggagcuaccugauuauucugguagauuaacuuugaacaugaaccucgcucccgcuguuucuccgucuuucccuggugaacgaauucuuuucuucaggucuauaguaccaucagccggaggcuucggauccgguuauauagacugucucauaccucaggaauggguacagcacuucuaccaggaagcagcgccuucgcaauccgcuguugcccugguuagauaugucaaccccgacacugggcguaacaucuuugaggccaaguuacauagagaaggguuccucaccguggcuaacucugggaacaauccuauuguggucccccccaaugguuauuuuagauuugaagcuuggguuaaucaguuuuauacacuugcccccaugggaucuggacaggggcguagaagggcccaguaa

SEQ ID NO: 5012 - RNA, 1653 nt, Artificial Sequence
  VP1__Norovirus__AFN06725
augaagauggcgucgaaugacgcugcuccaucgaaugauggugcugccaaccucguaccagaggccaacaaugagguuauggcacuugaaccgguggugggagccucaaucgcagcuccuguugucggucagcaaaauauaauugaccccuggauuagagaaaauuuuguccaagcaccacagggcgaguucacugucucaccaaggaauucgccuggugagaugcuuuuaaaucuugaguugggcccagaacuuaaucccuauuuaagucauuugucccgcauguacaacggauaugcugguggcaugcagguucaggugguccuagcugggaaugcguucacagcugggaaaaucaucuuugccgccguaccaccacauuucccuguagaaaacaucagugcagcccagauaacuauguguccccaugugauuguugaugugagacaacuugaaccagugcuucugccccucccugauauaaggaacagguucuuccauuacaaccaagagaacaccccccggaugaggcuuauagccaugcuuuauacaccucugagggccaauucuggugaggacguguucacuguguccugcaggguuuugacucgucccgcuccagauuuugaguucacauuuuuagugccaccaacuguugaaucaaagacaaaaccuuucacuuugccuauucugacccuuggugaguugucuaauucucgcuuuccggcugcuauagauaugcuuuauacugauccuaaugaaucaauaguuguacaaccccaaaaugguaggugcacucuugauggcaccuugcaaggcacaacacaauugguccccacacaaauuugugccuuuagaggcacucugaucagccagaccgcgagagcggccgacucaacagauuccccccagagagcccgugaucauccauuacacguccaggucaagaaccuagacggcacacaauacgacccaacggaugauauaccugcaguccugggggcuauugacuucaaagguacaguuuuuggaguggccagucaaagggaugucucugggcaacaagaacagggccacuaugccacccgagcccaugaagcacacauugauacaacugacccaaaguaugcacccaaauuaggcacaauccuuauuaaaucugaaucuaaugauuuuacuacaaaucagcccauuagguucacuccggugggcaugggugacaacaauuggagacagugggaguuaccugauuauucugguagauuaacuuugaacaugaaccucgcucccgcuguuucuccgucuuucccuggugaacgaauucuuuucuucaggucuauaguaccaucagccggaggcuucggauccgguuauauagacugucucauaccucaggaauggguacagcacuucuaccaggaagcagcgccuucgcaauccgcuguugcccugguuagauaugucaaccccgacacugggcguaacaucuuugaggccaaguuacauagagaaggguuccucaccguggcuaacucugggaacaauccuauuguggucccccccaaugguuauuuuagauuugaagcuuggguuaaucaguuuuauacacuugcccccaugggaucuggacaggggcguagaagggcccaguaa

SEQ ID NO: 5013 - RNA, 1629 nt, Artificial Sequence
  VP1__Norovirus__AFN06726
augaagauggcgucgaaugacgccgcuccaucuacugauggcgcagccggccucgugccagaaaguaauagugaggucauggcucuugagccuguggcuggugcugccuuggcagccccgguuaccggucaaacaaauauuauagacccuuggauuagagcaaauuuuguccaggccccuaauggugaauucacaguuucuccccgcaaugccccuggugaagugcuauugaaucuagaauuggguccagaauuaaauccuuaucuggcacauuuggcaagaauguacaacggguaugccggugggauggaggugcaggucaugcuagcugggaacgcguucacagcuggcaaauuggucuucgcugcuguaccaccucauuuuccgguugaaaaccuuagcccacagcaaauuaccauguucccccaugugauuauagauguuaggacuuuggaaccuguuuuguugccacuccccgauguuagaaauaauuucuuucauuauaaucaaaaagaugauccuaagaugagaauuguggcuaugcuuuauacuccccucagguccaaugguucuggugaugauguguuuacagucucuuguaggguguugacuagacccuccccugauuuugauuuuacauaccuggugccaccaacaguggaauccaaaacaaaaccauuuacucuuccaauccuuacacuuggggagcuuuccaacucuagauuuccaguguccauagaucagauguacacuagccccaaugaagucauaucugugcagugccagaauggaaggugcacacuggauggggagcuccaaggaacaacacagcuccaaguuaguggcauuugugcauucaaaggagaagugaccgcccacuugcaggacaaugaucaccuauacaacaucaccaucacaaacuugaauggguccccuuuugaucccucugaggacauccccgccccccugggugugcccgacuuucagggaagggucuuuggugucaucacucaaagagacaaacagaaugccgcuggacaaagccagccggcaaacaggggacacgaugcuguaguucccacuuacacagcccaguacaccccaaaauugggucagguucaaauuggcacauggcagaccgacgaucuuaaagucaaccaaccaguaaaauucaccccagucggucucaaugauacagaacauuucaaucagugggugguuccuagguacgcuggugcuuuaaaucuaaauacaaaucuugcccccucuguugcuccaguguuuccaggggagcguuugcucuucuuuaggucauaccucccccuuaagggugguuauggaaacccagcuauugauugccugcuaccacaagagugggugcagcauuuuuaucaggaagcagcccccucaaugagugagguggcccuugucagauacaucaauccggacacuggccgggcgcuguuugaggccaaacuccacagagcugguuucaugacagucucgaguaacaccagugcuccggugguugugccugccaacggauacuucagauuugacucuugggugaaccaauuuuauucucuugcccccaugggaacuggaaaugggcguagaaggauucaguaa

SEQ ID NO: 5014 - RNA, 1617 nt, Artificial Sequence
  VP1__Norovirus__AFN06727
augaagauggcgucgaaugacgcuacuccaucugaugauggugcagccggccucguaccagagaucaacaaugagguuauggcucuugaacccgucgcuggggcuuccauugcagcccccguugucggacaacaaaauauaauugaucccuggauuagaaauaauuuuguacaagccccugcuggugaauuuacagucuccccuagaaauucucccggagaacuuuugcuugauuuagagcugggcccugaacuaaauccuuaucuugcacaucuggcuagaauguauaaugggcaugcgggaggaauggaagugcagauaguacuagcugggaaugcguucacagcugguaagauccuauuugcugccaucccaccuagcuuccccuaugaaaauuugucacccgcucaacugacuaugugcccccacgugauaguggaugugagacaacuggaaccgguucuccugccaaugccugacauaaggaauguuuucuaucacuacaaccaaaacaacagccccaaacucaggcuuguagcaaugcuguacacuccucugagagcuaacaacucaggugaugacguguucacggugucaugccgcguuuuaacacgucccuccccagauuuccaauucaccuuucuggucccaccuacaguugagucuaaaacuaaaaauuucacucuaccuguucucagagucuccgagaugacaaacucaagguuuccagucguucuggaccaaauguacacgagcaggaaugaaaacaucauuguccaaccccaaaauggcaggugcacgacugacggugagcuccuuggcaccaccaucuugcaguccgugucuauuugcaacuuuaaaggaaccaugcaggcagaauugagugaucaaccacgauaccaauaccaacugcaacuuaccaauuuggauggcucacccauagacccaacagaugaugugccugccccucuuggcacaccagauuuucaagcuauguuguauggcguugcgagucaacguuccuccagagacaaugccacuagggcacaugaugcacaaauugacacugcgggugacacauucgccccaaagauuggccagguucguuucaaaucaaguuccaaugacuuugaccuacaugacccuacaaaauucacgcccauuggcgucaauguggacgaccagcacccuuuuagacaauggucucuaccaaauuaugguggucaucuugcccugaauaaucauuuggccccugcuguaacgccacucuucccuggcgaacaaauuuuauucuucagaucauacauuccaagcgcuggaggucacacagacggugcuauggauugcuugcuaccccaagaauggauugagcacuucuaccaagagucagccccuucccaaucugacauugcauuagugagguucauaaacccugacacaggaagagugcucuuugaagccaaauugcacaaacaaggcuuccucacaauugcagcaucuggagaccaccccaucgugaugcccacuaaugguuauuucagguuugaagcuugggucaaccccuucuacacucucgcccccgugggaacugggucugggcgcagaaggauccaauaa

SEQ ID NO: 5015 - RNA, 1647 nt, Artificial Sequence
  VP1__Norovirus__AFN06728
augaagauggcgucgaaugacgcugcuccaucuaacgauggugccgccggccucgucccagagaucaacaaugaggcaauggcgcuagagccaguggcgggugcagcgauagcagcaccccucacuggccagcaaaacauaauugaucccuggauuaugaauaauuuugugcaagcaccugguggugaguuuacagugucaccuaggaauuccccuggugaagugcuucuuaauuuagaauuagguccagaaauaaaccccuauuuggcucaccuugcuaggauguacaaugguuaugcagguggguuugaagugcagguaguccuggcuggaaacgcguuuacagcaggaaaggugaucuuugcagcuauaccccccaauuuuccaauugauaaucugagcgcagcacaaauuacaaugugcccgcaugugauuguggaugucaggcagcuggaaccaauuaaucuuccgaugccugauguccgcaacaauuucuuucauuauaaucaagggucugauucgagguuacgcuuaauugcaaugcuguauacaccucuuagggcaaacaauuccggagaugauguuuuuacuguguccuguagaguauuaacuaggccuagcccugauuucucauucaauuuucuugucccacccacuguggaaucaaagacaaaacccuucacccuccccauucugacuaucucugaaaugucuaauuccagguuuccagugccaauugacucucuacacaccagcccgacugagaacauuguuguccagugccaaaaugggcgcgucacucuugacggugaguuaauggguaccacccaacucuugccgagucagauaugugcuuucaggggcacgcucaccagaucaacaagcagggccagugaucaagccgacacagcaaccccuagguuauucaauuauuauuggcacauacaauuggacaaucuaaauggaacccccuacgacccugcagaggacauaccagccccucugggaacaccagacuuccggggcaaggucuuuggcguagccagccagagaaacccugacagcacaacaagagcacaugaagcaaaaguggacacaacaucuggucgcuucaccccgaaauuggguucccuagaaauauccacugaauccgaugacuuugacccaaaccaaccaacaagauucaccccaguuggcauugggguugacaaugaggcagauuuucagcaaugguccuuaccugacuauuccggucaguucacucacaacaugaacuuagccccagcugucgcccccaauuucccuggugagcagcuucuuuucuuccgcucacaguugccaucuucuggugggcggucuaacgggauucuagacugccuggucccccaggaauggguucaacacuucuaccaggaaucagccccugcccaaacacagguggcccugguuagguaugucaacccugacacugguagagugcuauuugaggccaagcuacauaaauuagguuucaugacuauagcuaagaauggugacucuccaauaaccgucccuccaaauggguacuuuagguuugaaucuugggugaaccccuuuuauacacuugcccccaugggaacuggaaaugggcgcagaaggauucaauaa

SEQ ID NO: 5016 - RNA, 1647 nt, Artificial Sequence
  VP1__Norovirus__AFN06729
augaagauggcgucgaaugacgcugcuccaucuaacgauggugccgccggccucgucccagagaucaacaaugaggcaauggcgcuagagccaguggugggugcagcgauagcagcaccccucacuggccagcaaaacauaauugaucccuggauuaugaauaauuuugugcaagcaccugguggugaguuuacagugucaccuaggaauuccccuggugaagugcuucuuaauuuagaauuagguccagaaauaaaccccuauuuggcucaccuugcuaggauguacaaugguuaugcagguggguuugaagugcagguaguccuggcuggaaaugcguuuacagcaggaaaggugaucuuugcagcuauaccccccaauuuuccaauugauaaucugagcgcagcacaaauuacaaugugcccgcaugugauuguggaugucaggcagcuggaaccaauuaaucuuccgaugccugauguccgcaacaauuucuuucauuauaaucaagggucugauucgagguuacgcuuaauugcaaugcuguauacaccucuuagggcaaacaauuccggagaugauguuuuuacuguguccuguagaguauuaacuaggccuagcccugauuucucauucaauuuucuugucccacccacuguggaaucaaagauaaaacccuucacccuccccauucugacuaucucugaaaugucuaauuccagguuuccagugccaauugacucucugcacaccagcccgacugagaacauuguuguccagugccaaaaugggcgcgucacucuugacggugaguuaauggguaccacccaacucuugccgagucagauaugugcuuucaggggcacgcucaccagaucaacaagcagggccagugaccaagccgacacagcaaccccuagguuauucaauuauuauuggcacauacaauuggacaaucuaaauggaacccccuacgacccugcagaggacauaccagccccucugggaacaccagacuuccggggcaaggucuuuggcguagccagccagagaaacccugacagcacaacaagagcacaugaagcaaaaguggacacaacaucuggucgcuucaccccgaaauugggcucccuagaaauauccacugaauccggugacuuugacccaaaccaaccaacaagauucaccccaguuggcauugggguugacaaugaggcagauuuucagcaaugguccuuaccugacuauuccggucaguucacucacaacaugcacuuagccccagcugucgcccccaauuuuccuggugagcagcuucuuuucuuccgcucacaguugccaucuucuggugggcggucaaacgggauucuagacugccuggucccccaggaauggguucaacacuucuaccaggaaucagccccugcccaaacacagguggcccugguuagguauguuaacccugacacugguagagugcuauuugaggccaagcuacauaaauuagguuucaugacuauagcuaagaauggugacucuccaauaaccgucccuccaaauggguacuuuagguuugaaucuugggugaaccccuuuuacacacuugcccccaugggaacuggaaaugggcguagaaggauucaauaa

SEQ ID NO: 5017 - RNA, 1644 nt, Artificial Sequence
  VP1__Norovirus__AFN06730
augaagauggcgucgaaugacgcugcuccaucgaaugauggugcugccaaccucguaccagaggccaacaaugagguuauggcacuugaaccgguggugggagccucaaucgcagcuccugucgucggucaacagaauauaauugaccccuggauuagagaaaauuuuguucaggcaccacagggugaguuuacuguuucaccaaggaacucgccuggugagaugcuucuaaaucuugaauuaggcccagagcucaacccuuaucugagucaucuaucccgcauguacaacgguuaugcuggugguaugcagguucaggugguccuagcugggaaugcguucacagcugguaaaaucaucuuugccgccguuccaccacauuucccuguagagaauaucagugcagcccaaaucaccaugugcccccaugugauuguugauguaaggcagcuugagccagugcuuuugccccucccugacauaaggaacagauucuuccauuauaaucaggaaaacaccccucgaaugagacuuguggcuauguuguauacaccccuuagagcaaacucuggugaggauguguucacagugucuugcagggucuugacccgcccagccccugacuuugaguucacguucuuagugccaccaacuguggagucaaagacuaagccuuuuacacucccuauuuugacucuuggagagcuauccaauuccagauuccccgcuccaauagacaugcuguacacagaucccaaugagacaauugugguacaaccacaaaauggcagaugcacccuagauggaacacuccaagggacuacccagcuggugcccacccaaauuugcuccuuuaggggcacgcuaauuagccagacgucgaggucugcagagucaacagauucagcuccacgggugaggaaccacccucuccacguucaguugaagaaccuugaugggacaccauaugauccaacagaugagguaccagcaguucugggugccauagauuucaaaggaacuguguuuggaguugcuagccagagaaacaccacagggagcucugcaggagcgacccgugcucaugaggugcacauagauaccacaaaccccagauacaccccaaaacuugguucuguguugauguauucugagucuacugauuuugaugauggacaacccacccguuucaccccuauuggcaugggagcagaugauuggcgccaaugggaauugcccgaauauuccggucaccucacucuuaauaugaaccuggcccccgcagucgccccugcuuuccccggugagcgcauccucuucuuuaggucgguggugccaucugcuggugguuaugggucaggccagauagacugccucaucccacaggaauggguucagcacuucuaucaggaggccgccccaucacaaucugcgguggcucuuauuagauauguuaauccugacacugggagaaacaucuuugaggcaaagcugcauagggaaggauucaucacuguggcaaauucuggaaacaaccccauaguugugcccccaaaugguuauuucagguucgaggccugggucaaucaauuuuauacacucacccccaugggaacuggacaggggcguagaagaguucaauaa

SEQ ID NO: 5018 - RNA, 1623 nt, Artificial Sequence
  VP1__Norovirus__AFN06731
augaagauggcgucgaaugacgcagcuccaucuagugauggugcagcaggccucguaccagagaucaauaaugaggucaugccccuugaacccguggcuggugcaucgcuggcgacaccagucgucgggcaacaaaauauaauugaucccuggauaagaaauaauuuugugcaggcuccugcaggugaguuuacuguuuccccuagaaauucccccggagagaucuugcuugauuuggaauugggaccagaauuaaaccccuaucuugcccauuuggcccgcauguauaaugggcacgcugguggcauggaagugcaaauugugcuggcugggaaugcguucacagcaggcaagaucauauuugcugccauccccccaggguucccauaugaaaauuugucaccuucucaaauuacaaugugcccacaugucauaauugauguuaggcaauuggagccaguucuuuugccuaugccagacauuaggaauaauuucuuccauuauaaucagggcaaugauccaaaauugaggcuaguugcuaugcucuacacuccuuuaagggccaauaacucuggugaugauguguucacaguuucuugcagggugcuuacaaaaccuucacccgacuuugaauucacauucuuagucccccccacagucgagucuaagaccaaacaguucaccuugcccauccucaaaauaucagagaugaccaauucaagauucccagugccaguggaugugauguacacggccaggaaugagaaccaggucguccaaccacagaaugguagaguuacgcucgacggugagcuguugggcaccaccccccugcuggcuguuaauauauguaaauuuaagggagaagucauagccaagaauggagaugugagguccuacagaauggauauggaaaucaccaacacugauggaacaccuauugacccuacagaggacacacccggucccauuggcucaccagauuuucaaggcauacucuuuggcguugccagucagcgcaauaagaaugagcagaacccugccacgagggcucaugaggccaacaucaacacugguggggaccaguaugcccccaaacuagcccaagugaaguucuuuucagagucccaagauuuugaggugcaccaacccacgaucuucaccccgguuggaguggcaggggacaccucucacccguucagacaauggacgcugccacgauacgguggacaccucaccaauaauacccaucuggcuccagcaguggcaccacuguucccaggagagcagcuccuguuuuucaggucacaaauacccaguucugguggucaugaacaggguuacauggauugucuugucccacaagaauggguccagcacuucuaccaggaagcugccacggcccaaucugagguggcccucauaagauucaucaacccagacaccgguagaguccucuuugaggcuaagcuacacaagcaaggcuuuauaacuguggcucacaccggugacaauccaauugucaugccaccgaauggguacuucagauuugaggcuuggguuaaucaguuuuauucacuugcccccgugggaacugggaacgggcguaggaggguccaauaa

SEQ ID NO: 5019 - RNA, 1623 nt, Artificial Sequence
  VP1__Norovirus__AFN06732
augaagauggcgucgaaugacgcugcuccaucuaaugauggugcuacgggccucgucccagagaucaaccacgagacccuuccucuggaaccgguggcgggugcagccauugccgcgccugucacuggccaaaauaauauaauugaucccuggauuagaacaaauuuuguacaagcacccaauggagaguucacugucucaccuagaaacucuccuggagaaauucuuuuaaauuuggaauuggguccugauuuaaacccauauuuggcacacuuaucuagaauguacaauggguaugcugguggcguggaaguucaaguccuccuagcagggaacgcguucacugcagggaaaauucucuucgcugccgugccaccaaauuucccaguugaauucuugaguccugcacaaaucaccauguugccacacuuaauaguugauguuagaacccuugaaccuaucaugauaccacucccugauguuaggaacaccuucuuccauuacaauaaccaaccugccaaccgcaugcgacugguagccauguuguauaccccuuugagaucuaaugguuccggcgaugaugucuucacuguuucauguagagugcugacuaggcccaccccagauuuugaguucacauauuugguccccccuucaguagagucuaagacuaaacccuuuucucuaccuauauuaaccauuucugaauuaaccaauucaagauuuccugcacccauagauucauuguacacagcccaaaacaacaaucucaauguccaaugucaaaauggucggugcacacuggauggugaacugcagggaaccacucaguugcugccuucaggcauaugugcuuucaggggcaaauuaacagcagauguacaccaaagccacgaugacagauggcacaugcagcugacaaaucuuaaugggacccccuuugauccaacagaggaugugccagcuccguuaggcaccccagauuucacaggccuccucuucggaguggcgagucagaggaauguuguauccaauccaaacaccaccagggcacacgaggcugugaucuccacaaccaguucacaguuugugccaaaauuaggaucaaucaacuuugguaguacaagugaugauuuccaguuacaacaacccaccaaauuuacaccaguuggaauuaagguugagaguggacaugauuuugaccaaugggcccugcccagauauucaggucauuuaacccuuaauaugaaucuugccccgccuguugcuccaaauuucccuggugaacagcuguuguucuuuagaucaaauguuccuugugcugguggcgucagugauggugucaucgacuguuuguugccucaggaguggauacagcacuucuaccaggagucugcucccucccagucugauguggcccuuaucagguacgucaauccugacacgggucgcacacucuucgaggcgaaacuccacagaacaggcuacaucacuguugcucauucaggugauuauccccuuguuguccccucuaauggauacuucagauuugauucuugggugaaccaguuuuacucacucgcccccaugggaacuggaaacgggcgcagacgggugcaguaa

SEQ ID NO: 5020 - RNA, 1623 nt, Artificial Sequence
  VP1__Norovirus__AFN06733
augaagauggcgucgaaugacgccgcuccaucaaaugauggugccgccggccucgugccagaaaguaguaaugaggcaauggcucuggaacccguggugggggcaucuuuagccgccccugucacuggccaaacuaauauaauagaccccuggauuagaacuaauuuuguccaagccccuaauggugaauucacaguuuccccucgaaacuccccuggagagguauuggucaauuuggagcuagguccagaacugaacccuuaucuggcacacuuagcuaugauguacaaugguuaugcgggugguauggaagugcaaguguugcucgcagggaacgcguucacugcuggcaagaucaucuuugcugccgugccaccuuacuuuccaguggaaaaucuuagcccuucucaaauaacaauguucccacaugugauuauugauguuagaaccuuggaaccuguauuacucccaaugccugauguuagaaguaccuuguuccauuuuaaucaaaaggaugagccuaagaugagacuuguugcuaugcuuuauaccccucuucguucuaaugguucuggugacgauguuuucaccgucucguguaggauccuuacuaggcccuccccugaauuugauuucacauauuuaguaccaccaacaguagaaucaaaaaccaaaccauucacacuaccuguacuaacacugggagaauugucuaacucuagauuuccccucucuauugaugaaaugguuaccagccccaaugaguccauaguuguccagccacagaaugguaggguuacgcuggauggggagcuguugggcacaacucaauuacaagcaugcaacauuugcucuauaagggggaagguaacagggcagguuccuaaugaacaacauauguggaaccuagagaucacaaaccuaaaugggacacaauuugaccccacagaugaugucccagccccccuuggugugcccgacuuugcaggugagguuuuugguguacucagccagagaaauagaggugagagcaauccagcaaacagggcucaugaugcugucguggcuaccuacagugacaaguacacccccaaacugggcuuagugcaaauuggaacuuggaacaccaaugauguugaaaaucagccaacaaaauucaccccaauugguuugaaugagguugccaauggccaucgauuugaacaguggacuuugccuagguauucuggugcccuaacacuaaacaugaauuuagccccugcuguggcuccgcucuuuccuggagagcgucuccuuuucuuccgcucuuauguuccauuaaaagguggauuugguaacccugcuauagauugucuggugccucaagaguggguucaacacuucuaucaggagucugcccccucucugggggauguggccuuggucagguacgucaacccagacaccgggcgcguccuuuuugaggccaaacuccacaaggguggauuccugacugugucaagcacuagcacagggccuguuguggugccagccaauggcuauuucagauuugauucuuggguuaaucaauuuuacucucuugcccccaugggaacugggaaugggcgcagaagauuucaguaa

SEQ ID NO: 5021 - RNA, 1623 nt, Artificial Sequence
  VP1__Norovirus__AFN06734
augaugauggcgucuaaggacgccccaacauccccugauggcgccaguggcgccggccagcugguaccggaggcuaauacagcugagcaaauuucaauggacccuguugcgggugcuucaacagcggucgcaacagccggacaagucaauaugauugacccauggauuuuuaauaauuuuguccaggcaccccaaggagaauuuacuauuuccccuaauaauacccccggugauaucuuguuugaucuacaauuaggaccccaucuuaacccauuucuggcucaucuuucacagauguacaauggaugggucggcaauaugcguguacgcauauuguuggcaggcaaugcuuuuacagcugggaaaauaaucauuugcuguguucccccugguuuugaugcuagaauacucacaauugcucaggcaacucucuucccacaccugauugcugauguuaggacucuugagccuguggagcuuccucuggaggacgugcguaauguucucuuucacaauagcagccagccgcaaccaacaaugcgauugguggcuauguuguauaccccacuccgcacgggcgguggcucuggaggcacugaugccuuugugguggcggguaggguacuuacgugcccugccccugauuuuagcuuuuuguuucuuguccccccuucuguugagcaaaagaccaggguauucagugucccuaauguaccucugaaagaccuuucaaauucucgugucccugugccuauacaggguauguuuauguccccagaugucaaccagucaguccaguuccagaacgggcguugucagauugauggccagcuucagggcaccaccccugucucgcuuagccaacuuugcaagaucagggguaagacuucaagcaaugccagagugcucaaucugagugagguggaugguacaccuuucaucccucucgaaucgccagcaccaguugguuuucccgaucuaggaggcugugacuggcauguaaauuucacuuuccaggcucagaaucaggacccgucucaaagugugaccuuugcaacuaaugaugcuagcuuuguuccauacuuaggcagcaucuccccucacaacgggggggauuuucauucaggugacaucauagguagccuuggcuggauuuccgccccguccgacaguucccaacuuaaugucuggacaauaccgaaguacggcuccagccucccagauguuacccaccuugcaccugcuguguuccccccagguuuuggggagguuaucuuguacuuucauuccacuuuuccagguucuggccagccagggcaacuccaagucccaugccuauuaccccaggaguucaucacucacuucugcaaugaacaggcucccaucgcuggggaggcugcccuccuccauuauguggacccugauacagggcgaaacuugggggaguuuaaacuuuaccccgauggguucaugaccugugucccuaauaguguuaguaguggcccucaaacucuucccaucaauggagucuuugucuuuguuucaugggugucuagauuuuaucaacucaagccugugggaacggccucagcggcuagaaggcuuggacugcggcgcauauaa

SEQ ID NO: 5022 - RNA, 1632 nt, Artificial Sequence
  VP1__Norovirus__AFN06735
augaugauggcgucuaaggacgcuucaccaagcgcagauggcgcgaauggcgccggucagcuugugccggagguuaauaaugcugaaccacugccacuugauccaguggcgggagcuuccaccgcucuugccacugcuggacaaguuaauaugauugacccauggauuuucaauaacuuuguucaggccccucagggugaauucaccauauccccaaauaauacccccggcgauauucuguuugauuugcaauuaggcccacaccuaaauccuuuccuagcacauuugucccagauguauaauggcuggguugguaauaugcgagucagggucaucuuggcuggcaaugccuucacugcugguaaaguuauaauuuguuguguucccccuggcuuucaaucuaggacccuuucuauagcucaggccacacucuuuccccacaucauagcugaugugcgaaccuuggaaccaauugagaucccccuagaggauguuaggaauacacuuuaccauacuaaugauaaucaaccaacaaugcgucuauugugcaugcuuuacacgccacugcgcaccggugguggcucuggcgguacagaugcauuuguuguggcaggccgaguucuaacuuguccuaguucugauuuuaauuucuuguuccugguuccaccuaccguggagcagaaaacccgccccuuuagcgugccuaauauaccuuugcaguugcuuuccaauucccguguucccaaccucauacaaagcaugguccuuucacccgaucaggcccagaauguccaauuccagaauggccgcuguaccacugaugggcagcuuuuaggcacaacaccuguuucuguuagucagauuuuaaaguuuagaggaaaagugucagcuggcucuagagucaucaaucuuacugaacuggaugguucccccuuucuggcuuuugaggccccagcacccacggguuuccccgacuuggggaccagugacuggcauguugaaaugagccuuaauucaaacagccaaaguucuggcaacccaauuuuguugagggacauacaaccaaauucuucugauuuugugccacacuuggguagugugucugucaccacugcaauugauguggcuggggauuacacugguacaauccaauggacuucucaaccauccaauguuaccccagucccugaugucaacuucuggaccaucccccaguaugggucaaauuuggcagaagcuucccagcuggccccuguaguauaccccccgggguuuggugaggcuauaguguauuucauguccccuauaccaggcccuaauacagcacacaaacccaacuuggugcccugccuacucccacaagaauuugugacucauuuugucagugaacaagcuccaucuaugggugaggcagcccucguccauuauguagacccagacaccaaucgcaaccugggcgaguucaaauuguauccugaagguuucaucaccugugugccaaaugguacugguccacaacaacuuccccucaauggggucuuugucuuugccucuugggugucuagauucuaccaauuaaagccugugggaacggccagcucggccagagguaggcuuggaguuagaagauaa

SEQ ID NO: 5023 - RNA, 1635 nt, Artificial Sequence
  VP1__Norovirus__AFN06736
augaugauggcgucuaaggacgccccaacaaacauggauggcaccaguggugccggucagcugguaccagaggcaaauacagcugaaccuauaucaauggauccaguggcuggagccgcaacagcgguugcaacugcuggacaaauuaauaugauugaccccuggauaaugaguaauuuugugcaagccccacaaggggaguucacugucucaccaaauaauaccccuggagaugucuuauuugaucuacaauugggaccccaauuaaauccauuccucgcccaucuagcccagauguauaacgguuggguaggcaauaugcgugugaaggugcugcuugccggcaacgcuuucaccgcagggaagauaauaauuaguugcauaccuccagguuucaccucccaaaacauuuccauugcucaaaugacaauguucccucaugucaucgcugacgugagggucuuggaaccuauagaaauaccccuagaggaugugaggaaugugcuguuucacaccaaugacaaccguccaacaaugaggcucguguguaugcuguacacuccuuugcgagccaauggcaguucuucugguacggauccuuuugucauagcuggcaggguucucaccugcccagauucaaauuuuaguuuucuauuuuuaguaccccccaauguggaacaaaagacuaggccuuucaguguccccaauauaccuuugaacacacuaucaaauucaagggugccaucauugaucaagucuaugacuauuucuagagaucagaaucagauuauucaauuucaaaauggcagaguuacauuggauggucagcuacagggcaccacaccuacaucagugagccaguuguguaaaauuagagguacuacguaucaugcaacuggagguaaugggauaaauuuaacagaauugaauggugaaccauaccaugcuuuugaaagucccgccccaauaggauucccagaucuuggugguugugauuggcaucuuacagcaacccccacgcaggcuuuuaacgauggagcaaaagucgugcgccugucagucacccagggcgcagcuuuugccccacauuuaggcaccauacauuacacuacaacugaccaugauuaugaccccaauacuagcauaauuuguacauuagauugguugucccaaacuacuggucaaaacaauguugaucccuggcaaauaccgacuuaugggucaacuuuaacugaagccgcccaguuggcaccacccaucuucccuccuggguuuggagaaacauugguuuucuuucuaucagacuuccccaucuccaauggcaaaaaugggcucaguguaccaugcacccuuccacaagaauuugucacccauuuugugaaugagcaggccccaauuagaggagaggccgcccuuuugcauuauguugauccagacacucaccgcaaucuuggagaguuuaaauuguauccagaaggcuuuaugacuugugucccuaacacuaguggugguggcccccaaacuuugccuaucaauggagucuuugucuuuguuucuugggucucucgcuuuuaucaguugaagccugugggaacggccggugcggcucguaggcuugguaucaggaggucauaa

SEQ ID NO: 5024 - RNA, 1635 nt, Artificial Sequence
  VP1__Norovirus__AFN06738
augaugauggcgucuaaggacgccccaacaaacauggauggcaccaguggugccggccagcugguaccagaggcgaauacagcugagccuauaucaauggagcccguggcuggggcagcaacagcugccgcaaccgccggccaaguuaauaugauugaccccuggauuaugaauaauuaugugcaagccccucaaggcgaauucaccauaucaccaaauaauacaccuggugauauuuuauuugauuuacaacuaggcccccaccucaaucccuuucugucucauuuggcccaaauguauaauggcuggguagguaauaugaaaguaaaaguucuauuggcagguaacgcuuucacagcggggaaaauaaucauuagcugcauaccuccuggcuuugcuucacaaaauaucucuauagcucaagcuacaauguucccccauguuauagcugauguuagggucuuggagcccauugaggucccguuggaggauguaagaaauguguuauuccauaacaaugacaacacaccaaccaugaggcugguaugcaugcucuacacccccuugcgugccaguggaaguucaucugggacggaccccuuugugauagcugggcguguguugacuuguccuaguccagacuuuagcuuucuauuuuugguuccccccaauguagaacaaaagacuaaacccuuuagugucccaaaccucccacuuaauguucuuucaaacucaagggugccaucucuaauaaaauucaugauggugucacaggaccacgggcaaauggugcaauuccaaaauggcagagucacgcuggacggacagcuccagggcacuacaccaacaucggccagccaacucuguaagaugcgggggacggucuaucacgccuccgguggccaagggcucaacuugacugaaauugaugguacuccuuaucaugcauuugaaagcccagcccccauugguuucccugauuuaggagauagugauuggcacauuaaugcuucaccugccaccaccuucaacacuggugaaagugucaagaggcuggauauggaacaagguuccucauucgccccgcauuugggcacugugcauuauaccaaugcugacuaugacgccaacacugauuuaaucugcucauuggaauggcuguccccccccaguggggguaccccaaacaaagucaaucccugggccauaccacgguacgguucgaccuuaaccgaagccgcucaauuggccccaccaaucuaccccccuggcuuuggugaagcaauaguuuucuuuaugucugauuuuccuauagcaaauggucaagauggauuaaaaguacccugcacuauaccccaagaguuuguaacccauuuuguuaaugaacaagcaccaacccguggggaggcugcccuccuccauuauguugacccugacacacaccgcaauuugggugaguucaaauuauacccugaaggguucaugacuuguguaccaaacuccaguggcagcgguccccaaacguugcccauuaauggggucuucacuuuugucucuuggguuucccguuucuaucaauuaaagccugugggaacgaccggaccgguucguaggcuuggaaucaggagaucauaa

SEQ ID NO: 5025 - RNA, 1635 nt, Artificial Sequence
  VP1__Norovirus__AFN06739
augaugauggcgucuaaggacgccccaacaaacauggauggcaccaguggugccggccagcugguaccagaggcaaauacagcugagccuauaucaauggagcccguggcuggggcagcgacagcugccgcaaccgcuggccaaguuaauaugauugaccccuggauuaugaauaauuaugugcaagccccucaaggugaauucaccauaucaccaaacaauacaccaggugauauuuuauuugauuuacaacuaggcccccaccuuaauccauuucuaucucauuuggcccaaauguacaauggcugggugggcaauaugaaggugaaaguucuauuggcaggcaacgcuuucacagcaggaaaaauaaucauuagcugcauaccuccugguuuugcuucacaaaauaucuccauagcccaagccacaauguucccccacguuauagcugaugucaggguccuggagcccaucgagguuccguuggaggacguaaggaauguguuauuccacaacaaugacaauacaccaacuaugaggcugguaugcaugcucuacacccccuugcgcgccagcgggaguucaucugggacagaccccuuuguaauugcugggcgugugcugacuugcccuaguccagauuucagcuuuuuauuuuuaguuccccccaacguagaacaaaagacuaaaccuuuuaguguuccaaaucuuccacucaauguucuuucaaacucgagaguaccaucccuaauaaaauccaugauggugucacaggaccacggacaaauggugcaauuucaaaauggcagagucacgcuggacggacagcuccagggcacuacgccaaccucagccagccaacucugcaagaugcgggggacgguuuaucacgccucugguggccaagggcucaauuugacugaaauugauggcacucccuaccacgccuuugaaagcccagccccuauugguuucccugacauaggagacagcgauuggcacauuaaugcuucaccugccaccaccuuugacagcggugaaagcaucaaaaggcuagacauggaacagggcuccucauucgccccacauuuggguacugugcacuacacaaaugcugacuauccugccaauacugacuuaauuugcucauuggaauggcugucccccccuagugggggcaccccaaacaaagucaacccuuggaccaucccgcgguacgguucaaccuuaacugaagccgcccaauuggccccaccaauuuacccccccgguuuuggugaagcaauaguuuucuucaugucugauuucccuauagcaaauggucaagauggauugaaaguacccugcacuauaccccaggaauuuguaacccauuuugucaaugaacaagcaccaacccguggggaggcugcccuccuucauuauguugacccugauacacaucgcaacuugggugaguucaaauuauacccugaaggauuuaugacuugugugccaaacuccaguggcagcgguccccaaacgcugcccauuaauggggucuucacuuuugucucuuggguuucccguuucuaucaauuaaagccugugggaacgaccggaccgguucguaggcucggaaucaggagaucauaa

SEQ ID NO: 5026 - RNA, 1623 nt, Artificial Sequence
  VP1__Norovirus__AFV08771
augaagauggcgucgaaugacgccaacccaucugauggguccgcagccaaccucgucccagaggucaacaaugagguuauggcuuuggagcccguuguuggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucuaaaucccuaccuaucucauuuggccagaauguauaaugguuaugcaggugguuuugaagugcaggugauccucgcggggaacgcguucaccgcuggaaaaauuauauuugcagcagucccaccaaauuuuccaacugaaggcuugagucccagccagguuacuauguucccccauauaauaguagauguuaggcaauuggaaccuguguugauccccuuaccugauguuagaaauaacuucuaucauuauaaucagucaaaugauucuaccauuaaauugauagcaaugcuguacacaccacuuagggcuaauaaugcuggggaugaugucuuuacaguuucuugucgaguucucacgagaccaucccccgauuuugauuucauauuuuuagugccaccuacaguugaaucaagaacuaaaccauucucugucccaauuuuaacuguugaagaaaugaccaauucaagguuccccauuccuuuggaaaaguuguucacgggccccaguaguaccuuuguuguucaaccacaaaacggcaggugcacgacugauggcgugcucuuagguaccacccaacugucuccugucaacaucugcaccuucagaggggaugucacccacauugcaggcagucguaacuacacaaugaaucuggcuucccaaaauuggaacaguuaugacccaacagaagaaaucccagccccucuaggaacuccagauuucguggggaagauucaaggugugcucacccaaaccacaaggacagauggcucgacccgcggucacaaagcuacaguguacacugggagugccgacuuuucuccaaaacuggguagaguucaauuugccacugacacagacaaugauuucgaugcuaaccaaaacacaaaguucaccccagucggcguuauccaggauggaaauacugcccaccgaaaugaaccccaacaaugggugcucccaagcuacucaggcagaaacacccauaaugugcaccuggcccccgcuguagcccccacuuuuccgggugagcaacuccucuucuucagaucuaccaugcccggaugcagcggguaccccaacauggauuuggacugucugcucccccaggaaugggugcaguauuucuaccaggaagcagccccagcacaaucugauguggcucugcuaagauuugugaauccagacacagguaggguccuguuugaguguaagcuucauaaaucaggcuauguuacaguggcucacacuggccaacaugauuugguuaucccccccaaugguuauuuuagauuugacuccugggucaaccaguucuacacacuugcccccaugggaaaugggacggggcguaggcgugcauuguaa

SEQ ID NO: 5027 - RNA, 1623 nt, Artificial Sequence
  VP1__Norovirus__AFV08774
augaagauggcgucgagugacgccaacccaucugauggguccacagccaaccucgucccagaggucaacaaugagguuauggcuuuggagcccguaguuggugccgccauugcggcaccuguagcgggccagcaaaauguaauugaccccuggauuagaaacaauuuuguacaagccccugguggagaguuuacaguauccccuagaaacgcuccaggugaaauacuauggagugcgcccuuaggccccgauuugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaacuggaaccuguguugauccccuuacccgauguuaggaauaauuucuaccacuauaaucagucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccaucccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgauccuacagaagaaaucccagccccccuaggaacuccagauuucguggggaagauucaaggugugcucacccaaaccacaaggacagauggcucgacccgcggccacaaagcuacaguauacacugggagcgccgacuuuucuccaaaacuggguaggguucaauuugccacugacacagacaaugauuuuguaacuaaccaaaacacaaaguucaccccagucgguguuauccaggaugguaguacuaccccccgaaaugaaccccaacaaugggugcucccaaguuacucaggcagaaacacucauaaugugcaccuggcccccgcuguagcccccacuuucccgggcgagcagcuccucuucuucagaucuaccaugcccgggugcagcggguaccccaacauggauuuggacugucugcucccccaggaaugggugcaguauuucuaccaggaagcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacgugcauuauaa

SEQ ID NO: 5028 - RNA, 1623 nt, Artificial Sequence
  VP1__Norovirus__AFV08777
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaagcaauuuuguacaagccccugguggagaguuuacaguauccccuagaaacgcuccaggugaaauacuauggagcgcacccuuaggcccugauuugaauccuuaccuuucccauuuggccagaauguacaaugguuaugcaggugguuuugaagugcagguaauccucgcggggaacgcguucaccgccgggaaaaucauauuugcagcagucccaccaaguuucccaauugaagguuugagccccagucaggucacuauguucccccacauaauaguagauguuaggcaauuggagccuguguugauucccuuacccgauguuaggaauaauuucuaccauuauaaucaaucaaaugaccccaccaucaaauugauagcaauguuguauacaccacuuagggcuaauaaugccggggacgaugucuucacaguuucuugucgaguccucacgagaccaucccccgauuuugauuucauauuuuuggugccacccacaguugaaucaagaacuaaaccauucucugucccaguuuuaacuguugaggagaugaccaauucaagguuccccauuccuuuggagaaguuguucacgggccccaguagugccuuuguuguucaaccacaaaacggcagaugcacgacugauggcgugcuccuagguacuacccaacugucuccugucaacaucugcaccuucagagggaaugucacccacauuucaggcagucguaacuacacaaugaauuuggcuucccaaaauuggaacaguuacgacccaacagaagaaaucccagccccucuaggaacuccagauuucguggggaagauucaaggugugcucacccaaaccacaaagacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacacccauaauguacaccuggcccccgcuguagcccccacuuucccgggcgagcagcuccucuucuuuagaucuacuaugcccggaugcagcggguaccccaacauggaucuggacugucugcucccccaggagugggugcaguauuucuaucaggaggcagccccagcacaaucugacguggcucuguuaagauuugugaauccagauacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcacuauaa

SEQ ID NO: 5029 - RNA, 1623 nt, Artificial Sequence
  VP1__Norovirus__AFV08780
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaauaauuuuguacaagccccugguggagaguucacaguauccccuaggaacgcuccaggugaaauacuguggagcgcgccccuaggcccugauuugaauccuuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccagguuacuauguucccccacauaauaguagauguuaggcaacuggaaccuguguugauccccuuacccgauguuaggaauaauuucuaccauuacaaucaaucaaaugaccccaccaucaaauugauagcaauguuguacacaccacuuagggcuaauaaugcuggggacgaugucuucacaguuucuugucggguacucacgagaccaucccccgauuuugauuucauauuuuuagugccacccacaguugaaucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgacugauggcgugcuccuagguaccacccaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucgugggaaagauccaaggugugcucacccaaaccacgagggcagauggcucgacccguggacacaaggcuacaguguacacugggagcgccgacuuugcuccaaaacuggguagaguucaauuugccacugacacagaccaugauuuugaugcuaaccaaaacacaaaguucaccccagucggugucauccaggauggugauacugcccaccgaaaugaaccccaacaaugggugcucccaaguuacucagguagaaauagucacaaugugcaccuggcccccacuguagcccccacuuuuccgggugagcaacuucucuucuuuagauccacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugaucugguuaucccccccaaugguuauuuuagguuugauucuugggucaaccaguucuacacacuugcccccaugggaaauggaacggggcguagacgugcauuauaa

SEQ ID NO: 5030 - RNA, 1623 nt, Artificial Sequence
  VP1__Norovirus__AFV08783
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacuauggagcgcgccuuuaggcccugaucugaaucccuaccuuucccauuuggccagaauguacaaugguuaugcaggugguuuugaagugcagguaauccucgcggggaaugcguucaccgccggaaaaaucauauuugcagcagucccaccaaauuucccaacugaagguuugagccccagccaagucacuauguucccccacauaauaguagauguuaggcaauuggaaccuguguugauccccuuacccgauguuagaaauaauuucuaccauuauaaucagucaaaugaccccaccaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggaaaugaccaauucaagguuccccauuccuuuggaaaaguuguucacaggccccaguagugccuuuguuguucaaccacaaaacggcaggugcacgacugauggcgugcuccuagguacuacccaacugucuccugucaacaucugcaccuucaggggggaugucacccacauuucaggcagucguaacuacacaaugaauuuggccucccaaaauuggaacaguuaugauccaacagaagaaaucccagccccccuaggaacuccagauuucguggggaagauucaagguaugcucacccaaaccacaaggacagauggcucgacccgcggccacaaagcuacaguguacacugggagcgccgacuuuucuccaaaacugggcaggguucaauuugccacugacacagacaaugauuuuguaacuaaccaaaacacaaaguucaccccagucgguguuauccaggaugguaguacuaccccccgaaaugaaccccaacaaugggugcucccaagcuacucaggcagaaacacucauaaugugcaccuggcccccgcuguagcccccacuuucccgggcgagcagcuccucuucuucagauccaccaugcccggaugcagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaacaggcuauguuacaguggcucacacuggccaacaugauuuaguuaucccccccaaugguuauuuuagauuugauuccugggucaaccaguucuacacacuugcccccaugggaaaugggacggggcguagacgugcauuauaa

SEQ ID NO: 5031 - RNA, 1623 nt, Artificial Sequence
  VP1__Norovirus__AFV08786
augaagauggcgucgaaugacgccaacccaucugauggguccgcagccaaccucgucccagaggucaacaaugagguuauggcuuuggagcccguugucggugccgcuauugcggcgcccguagcgggccaacaaaauguaauugaccccuggauuagaaauaauuuuguacaagccccugguggagaguucacaguauccccuagaaacgcuccaggugaaauacuauggagugcgcccuuaggcccugaucugaaucccuaccuaucucacuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugaucccccuaccugauguuaggaauaacuucuaucacuauaaccagucaaaugauucuaccauuaaauugauagcaaugcuguauacaccacuuagggcuaauaaugcuggggaagaugucuuuacagucucuugucgaguucucacgaggccauccccugauuuugauuuuauauucuuagugccaccuacaguugagucaagaacuaaaccauuuacugucccaaucuuaacuguugaagaaaugaccaauucaagauuccccauuccuuuggaaaaauuguucacgggucccagcagugccuuuguuguccaaccacaaaauggcagaugcacgacugauggcgugcucuuaggcaccacccaacugucuccugucaacauuugcaccuucagaggggaugucacccacauugcagguucucgcaauuacacaaugaauuuggccucucuaaauuggaacaauuaugacccaacagaagaaaucccagccccucuagggacuccagacuucgugggaaagauucaaggugugcucacucaaaccacgaagggagauggcucgacccguggccauaaagcuacaguuuacacugggagugcccccuuuacuccaaagcuggguaguguucaauuuaguacugauacagagaaugauuuugaaacucaccaaaauacaaaauucaccccagucggugucauccaggaugguggcaccacccaccgaaaugaaccccaacaaugggugcucccaaguuauucagguaggaaugucccuaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaagcuccauaaaucaggcuaugucacaguggcucacaccggccagcaugauuuggucaucccccccaaugguuauuuuagauuugacuccuggguuaaucaauucuacacgcuugcccccaugggaaauggaacggggcguagacgcgccuuauaa

SEQ ID NO: 5032 - RNA, 1623 nt, Artificial Sequence
  VP1__Norovirus__AFV08789
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcucccuuaggcccugaucugaaucccuaccuaucucauuuggccagaauguauaaugguuaugcaggugguuuugaagugcagguaauccucgcggggaacgcguucaccgccggaaaaauuauauuugcagcagucccaccaaauuucccgacugaaggcuugagucccagccaggucacuauguucccccacauaauaguggauguuaggcaauuggaaccuguguugauccccuuaccugauguuaggaauaacuucuaucauuauaaucaaucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuugacuguugaggaaaugaccaauucaagauuccccauuccuuuggaaaaguuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauucaaggugugcucacucaaaccacaaagggagaugguucgacccguggucauaaagcuacaguuuacacugggagugcccccuucacuccaaagcugggcaguguucaauucgguacugauacagaaaaugauuuugaaacucaccaaaacacaaaauucaccccagucggugucauccaggaugguggcaccacccaccgaaaugaaccccaacaaugggugcucccaaguuauucagguagagaugucccuaauguacaccuagccccugcuguagcccccacuuucccgggugaacaacuucuuuucuuuaggucuacuaugcccggaugcagcggguaucccaacauggauuuggauugccuacucccccaggagugggugcagcacuucuaccaagaggcagcuccagcacaaucugauguggcucuauugagauuugugaauccagacacgggcaggguucuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5033 - RNA, 1623 nt, Artificial Sequence
  VP1__Norovirus__AFV08792
augaagauggcgucgagugacgccaacccaucugauggguccgcagccaaccucgucccagaggucaauaaugagguuauggcucuggagcccguuguuggugccgccauugcggcaccuguagcgggccaacaaaauguaauugaccccuggauuagaaacaauuuuguacaagccccugguggagaguucacaguguccccuagaaacgcuccaggugaaauacuauggagcgcgcccuuagguccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuuaagccccagccaggucacuauguucccccauauaguaguagauguuagacaacuagaaccugugcugauucccuuacccgaugucaggaauaacuucuaucauuacaaucaaucaaaugacuccacuauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccucuggaaaaguuguucacgggccccagcagugccuuuguuguucaaccacaaaacggcaggugcacgacugauggcgugcuccuaggcaccacccaacugucuccugucaauaucugcaccuucagaggggaugucacccacaucacagguagucguaacuacacaaugaauuuggcuucucaaaauuggaacaauuaugacccaacagacgaaaucccagccccucuagggacuccagauuuuguggggaagauucaaggcaugcucacccaaaccacaaggacagauggcucgacacgcggccacaaagcuacaguguacacugggagcgccgacuuugcuccaaaacuggguagaguucaauuugaaacugacacagaccaugauuuugaagcuaaccaaaacacaaaguucaccccagucgguguuauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaagcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguucuacacgcuugcccccaugggaaauggaacggggcguagacguguaguauaa

SEQ ID NO: 5034 - RNA, 1623 nt, Artificial Sequence
  VP1__Norovirus__AFV08795
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuauaaucaaucaaaugacccuaccauuaaguugauagcaauguuguauacaccacuuagggcuaauaaugcuggggaugaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccacaucacagguagucguaacuacacaaugaauuuggcuucucaaaauuggaacgauuaugacccaacagaagaaaucccagccccucuaggaacuccagauuuuguggggaagauucaaggcguucucacccaaaccacaaggacagauggcucaacacgcggccacaaagcuacaguguacacugggagcgccgacuuugcuccaaaacuggguagaguucaauuugaaacugacacagaccgugauuuugaagcuaaccaaaacacaaaguucaccccagucggugucauccaagaugguggcaccacccaccgaaaugaaccccaacagugggugcucccaagcuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcaguauaa

SEQ ID NO: 5035 - RNA, 1623 nt, Artificial Sequence
  VP1__Norovirus__AFX95940
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacuaucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5036 - RNA, 1620 nt, Artificial Sequence
  VP1__Norovirus__AFZ84663
augaagauggcgucgaaugacgccagcccaucugauggguccacagccaaccucgucccagaggucaacaaugagguuauggcuuuggagcccguuguuggugccgcuaucgcggcaccuguagcgggccaacaaaauguaauugaccccuggauuagaaauaauuuuguacaagccccugguggagaguuuacaguauccccuagaaacgcuccgggugagauacuauggagcgcgcccuugggcccugauuugaaccccuaccuuucucauuuggccagaauguacaaugguuaugcaggugguuuugaagugcagguaauccucgcggggaacgcguucaccgccgggaaaaucauauuugcagcagucccaccaaauuuuccaacugaaggcuugagccccagccagguuacuauguucccccauauaauaguagauguuaggcaauuggaacccguguugauccccuuaccugauguuaggaauaacuucuaucauuauaaccaaucaaaugauucuaccauuaaauugauagcaaugcuguauacaccacuuagggcuaauaaugcuggggaugaugucuucacagucucuugucgaguccucacgaggccaucccccgauuuugauuucauauucuuggugccacccacaguugaaucaagaacuaaaccauucaccgucccaaucuuaacuguugaggaaauguccaacucaagauuccccauuccuuuggaaaaguuguacacgggucccagcagugcuuuuguuguccaaccacaaaauggcaggugcacgacugacggcgugcucuuaggcacuacccagcugucugcugucaacaucugcaccuucagaggggaugucacccacauugcaggcagucaugacuauacaaugaauuuggcuucucaaaauuggaacaauuaugacccaacagaagaaaucccagccccucugggaacuccagauuucgugggaaagauccaaggcaugcucacccaaaccacaagagaggauggcucgacccgcgcccacaaagccacagugagcacugggaguguccacuuuacuccaaagcugggcaguguucaauacaccacugacacaaacaaugauuuucaaacuggccaaaacacgaaauucaccccagucggcgucauccaggacgguaauaaccaucaaaaugaaccccaacaauggguacuuccaaauuacucagguagaacuggucauaaugugcaccuagcuccugccguugcccccacuuucccgggugagcaacuucucuucuuuagguccacuaugcccggguguagcggguaucccaacaugaaucuggauugccuacucccccaggaaugggugcagcacuucuaccaagaagcagccccagcacaaucugauguggcucugcugagauuugugaauccagacacagguaggguucuguuugagugcaagcuccauaaaucaggcuaugucacaguggcucacacuggcccacaugauuugguuaucccccccaaugguuacuuuagauuugauuccugggucaaccaguucuacacacuugcccccaugggaaauggagcggggcgcagacguguauuauaa

SEQ ID NO: 5037 - RNA, 1623 nt, Artificial Sequence
  VP1__Norovirus__AGG37871
augaagauggcgucgagugacgccaacccaucugauggguccgcagccaaccucgucccagaggucaacaaugagguuauggcucuggagcccguuguuggugccgccauugcggcgccuguagcgggccaacaaaauguaauugaccccuggauuagaaauaauuuuguacaggccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuucccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccagucggugucauccaagaugguggcaccacccaccgaaaugaaccccagcagugggugcucccaaguuacucaggcagaaacacucauaaugugcaucuggcccccgcuguagcccccacuuuuccgggugagcaacuucucuucuucagguccaccaugcccggaugcagcggguaccccaacauggauuuggacugucugcucccccaggaaugggugcaguacuucuaccaagaggcagccccagcacaaucugaaguggcucugcuaagauuugugaauccagacacagguaggguuuuguuugaguguaagcuucauaaaucaggcuauguuacaguggcucacacuggccaauaugauuugguuauuccccccaaugguuauuuuagguuugauuccugggucaaccaguuuuacacgcuugcccccaugggaaauggaacggggcguagacgugcaguauaa

SEQ ID NO: 5038 - RNA, 1623 nt, Artificial Sequence
  VP1__Norovirus__AGI96383
augaagauggcgucgagugacgccaacccaucugauggguccacagccaaccucgucccagaggucaacaaugagguuauggcuuuggagcccgugguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauacucgcggggaacgcguucaccgccgggaaaaucauauuugcagcagucccaccaaauuucccaacugaagguuugagccccagccaggucacuauguucccccacauaauaguagaugucaggcaauuggaaccuguguugauccccuuacccgauguuaggaauaauuucuaccauuauaaucaaucaaaugauuccaccaucaaauugauagcaauguuguacacgccacuuagggcuaauaaugccggggaugaugucuucacaguuucuugucgaguucuuacgagaccaucccccgauuuugauuuuauauuuuuggugccacccacaguugaaucaagaacuaaaccauuuucugucccaauuuuaacuguugaggagaugaccaauucaagguuccccauuccuuuggaaaaguuguucacaggccccaguagugccuuuguuguccaaccacaaaacggcaggugcacgacugauggcgugcuccuagguaccacucaacugucuccugucaacaucugcaccuucagaggggaugucacccauauuccaggcagucauaacuacacaaugaauuuggccucccaaaauuggaacaguuacgauccaacagaagaaaucccagccccucuaggaacuccagauuucguggggaagauucaaggugugcucacucaaaccacuaguacaaauggcucgacccgcggccacaaagcuacaguguacacugggagcgccgacuuuucuccaaaacuggguagaguucaauuuuccacugacacaaacaaugauuuugaaacuaaccaaaauacaaaauucaccccagucggcguuauccaggaugguaguacuaccccccgaaaugaaccccaacaaugggugcucccaaguuacucaggcagaaacauucacaaugugcaccuagcccccgcuguggcccccacuuucccgggcgagcagcuccucuucuucagaucuacuaugcccggaugcagcggguaccccaacauggauuuggauugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacgugcauuauaa

SEQ ID NO: 5039 - RNA, 1623 nt, Artificial Sequence
  VP1__Norovirus__AGI99552
augaagauggcgucaagugacgccaacccaucugauggguccgcagcuaaccucgucccaaaggucaacaaugagguuauggcucuggagcccguuguuggugccgccauugcggcaccuguagcgggccaacaaaauguaauugaccccuggauuaaaaauaauuuuguacaagccccugguggagaguuuacaguauccccuaaaaacgcuccaggugaaauacuauggagcgcgcccuugggcccugaucuaaaucccuaccuaucccauuuggccaaaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaccauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggggaugucacccacaccauagguagucguaacuacacaaugaauuuggcuucucaaaauuggaacaauuaugacccaacagaagaaaucccagccccucuaggaacuccagauuuuguggggaagauucaaggcguacucacccaaaccacaaggacagauggcucaacacgcggccacaaagcuacaguguacacugggagcgccgacuuugcuccaaaacuggguagaguucaauuugaaacugauacagaccaugauuuugaagcuaaccaaaacacaaaguucaccccaguuggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaggaggcagccccagcacaaucugauguggcucugcuaagauuugugaauccagacacaggaaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacggccacuauaa

SEQ ID NO: 5040 - RNA, 1623 nt, Artificial Sequence
  VP1__Norovirus__AGI99553
augaagauggcgucaagugacgccaacccaccugauggguccgcagccaaccucgucccaaaggucaauaaugagguuauggcucuggagcccguuguuggugccgccauugcggcaccuguagcgggccaacaaaauguaauugaccccuggauuaaaaauaauuuuguacaagccccugguggagaguuuacaguauccccuaaaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauuccccuacccgauguuaggaauaacuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacaaaaccauucucugucccaguuuuaacuguugaggagaugaccaauucaagauuccccauucccuuggaaaaguuguucacgggucccagcagugccuuuguuguccaaccacaaaacggcaggugcacgacugauggcgugcuucuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccucaacagugggugcucccaaguuacucaggcagagauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacggccacuauaa

SEQ ID NO: 5041 - RNA, 1623 nt, Artificial Sequence
  VP1__Norovirus__AGI99554
augaagauggcgucgagugacgccaacccaucugauggguccgcagccaaccucgucccaaaggucaacaaugagguuauggcucuggagcccguuguuggugccgccauugcggcaccuguagcgggccaacaaaauguaauugaccccuggauuaaaaauaauuuuguacaagccccugguggagaguuuacaguauccccuaaaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcaguuccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaacucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugacguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacggccacuauaa

SEQ ID NO: 5042 - RNA, 1623 nt, Artificial Sequence
  VP1__Norovirus__AGI99555
augaagauggcgucgagugacgccaacccaucugauggguccgcagccaaccucgucccaaaggucaacaaugagguuauggcucuggagcccguuguuggugccgccauugcggcaccuguagcgggccaacaaaauguaauugaccccuggauuaaaaauaauuuuguacaagccccugguggagaguuuacaguauccccuaaaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaacuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaacucaagauuccccauuccuuuggaaaaguuguucacggguccuagcagugccuuuguuguccaaccacaaaacggcaggugcacgacugacggcgugcuccuaggcaccacccaacugucuccugucaacaucugcaccuucagaggggaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacggccacuauaa

SEQ ID NO: 5043 - RNA, 1623 nt, Artificial Sequence
  VP1__Norovirus__AGK25882
augaagauggcgucgaaugacgccagcccaucugauggguccgcagccaaccucgucccagaggucaacaaugagguuauggcuuuggagcccguugucggugccgcuauugcggcgcccguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauucucgcggggaacgcguucaccgccggaaaaauuauauuugcagcagucccaccaaauuuuccaacugaaggcuugagucccagucaggucaccauguucccccauauaauaguggauguuaggcgauuggaaccuguguugauccccuuaccugauguuaggaauaauuucuaccacuauaaucagucaaaugauucuaccauuaaauugauagcaaugcuguacacaccacuuagggcuaauaaugcuggggaagaugucuuuacagucucuugucgaguucucacgaggccauccccugauuuugauuucauauuuuuggugccaccuacaguugagucaagaacuaagccauuuacugucccaaucuuaacuguugaagagaugaccuacucaagguuccccauuccuuuggagaaguuguucacgggucccagcagugccuuuguuguucaaccacaaaauggcagaugcacaacugauggcgugcucuuaggcaccacccagcugucuccugucaacaucugcaccuucagaggggaugucacccacauugcagguucucguaauuacacaaugaaucuggcuucucuaaauuggaacaauuaugacccaacagaagaaauuccagccccucuaggaacuccagauuucgugggaaagauccaagguaugcucacucaaaccacaaagggagauggcucgacccguggccauaaagcuacaguuuacacugggagugcccccuucacuccaaagcugggcaguguccaauucgaaacugacacagaaaaugauuuugaaacccaccaaaacauaaaauucaccccagucggugucauccaggaugguggcaccacucaccgaaaugaaccucaacaaugggugcucccaaguuauucagguagaaaugucccuaauguacaccuagccccugcuguagcccccacuuuuccgggugaacaacuccuuuucuuuagguccacuaugcccggaugcagcggguaucccaacauggauuuggacugccugcuaccccaggagugggugcagcacuucuaccaagaggcagcuccagcacaaucugauguggcucuauugagauuugugaauccagacacggguaggguccuguuugagugcaaacuccauaaaucaggcuaugucacaguggcccacaccggccagcaugauuugaucaucccccccaaugguuauuuuagguuugauuccuggguuaaccaauucuacacgcuugcccccaugggaaacggaacggggcguagacgugcuuuguaa

SEQ ID NO: 5044 - RNA, 1623 nt, Artificial Sequence
  VP1__Norovirus__AGK25884
augaagauggcgucgaaugacgccagcccaucugauggguccgcagccaaccucgucccagaggucaacaaugagguuauggcuuuggagcccguugucggugccgcuauugcggcgcccguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauucucgcggggaacgcguucaccgccggaaaaauuauauuugcagcagucccaccaaauuuuccaacugaaggcuugagucccagucaggucaccauguucccccauauaauaguggauguuaggcaauuggaaccuguguugauccccuuaccugauguuaggaauaauuucuaccacuauaaucagucaaaugauucuaccauuaaauugauagcaaugcuguacacaccacuuagggcuaauaaugcuggggaagaugucuuuacagucucuugucgaguucucacgaggccauccccugauuuugauuucauauuuuuggugccaccuacaguugagucaagaacuaagccauuuacugucccaaucuuaacuguugaagagaugaccaacucaagguuccccauuccuuuggagaaguuguucacgggucccagcagugccuuuguuguucaaccacaaaauggcagaugcacaacugauggcgugcucuuaggcaccacccagcugucuccugucaacaucugcaccuucagaggggaugucacccacauugcagguucucguaauuacacaaugaaucuggcuucucuaaauuggaacaauuaugacccaacagaagaaauuccagccccucuaggaacuccagauuucgugggaaagauccaagguaugcucacucaaaccgcaaagggagauggcucgacccguggccauaaagcuacaguuuacacugggagugcccccuucacuccaaagcugggcaguguccaauucgaaacugacacagaaaaugauuuugaaacccaccaaaacacaaaauucaccccagucggugucauccaggaugguggcaccacucaccgaaaugaaccucaacaauggguacucccaaguuauucagguagaaaugucccuaauguacaccuagccccugcuguagcccccacuuuuccgggugaacaacuccuuuucuuuagguccacuaugcccggaugcagcgggugucccgacauggauuuggacugccugcuaccccaggagugggugcagcacuucuaccaagaggcagcuccagcacaaucugauguggcucuauugagauuugugaauccagacacggguaggguccuguuugagugcaaacuccauaaaucaggcuaugucacaguggcccacaccggccagcaugauuugaucaucccccccaaugguuauuuuagguuugauuccuggguuaaccaauucuacacgcuugcccccaugggaaacggaacggggcguagacgugcuuuguaa

SEQ ID NO: 5045 - RNA, 1623 nt, Artificial Sequence
  VP1__Norovirus__AGK25887
augaagauggcgucgagugacgccaacccaucugauggguccgcagccaaccucgucccagaggucaacaaugagguuauggcucuggagcccguuguuggugccgccauugcggcaccuguggcgggccaacaaaauguaauugaccccuggauuagaaauaauuuuguacaggccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuucccauuccuuuggaaaaguuguucacgggucccagcagugccuuuguuguccaaccacaaaacggcaggugcacgacugauggcgugcuccuaggcaccacccaacugucuccugucaacaucugcaccuucagaggagauaucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacagugcacacugggagcgccgacuuugcuccaaaacuggguagaguucaauuugaaacugacacagaccaugauuuugaagcuaaccaaaacacaaaguucaccccagucggugucauccaagaugguggcaccacccaccgaaaugaaccccagcagugggugcucccaaguuacucaggcagaaacacucauaaugugcaucuggcccccgcuguagcccccacuuuuccgggugagcaacuucucuucuucagguccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcaguauaa

SEQ ID NO: 5046 - RNA, 1623 nt, Artificial Sequence
  VP1__Norovirus__AGK25890
augaagauggcgucgagugacgccaacccaucugauggguccgcagccaaccucgucccagaggucaacaaugagguuauagcucuggagcccguuguuggugccgccauugcggcaccuguggcgggccaacaaaauguaauugaccccuggauuagaaauaauuuuguacaggccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuucccauuccuuuggaaaaguuguucacgggucccagcagugccuuuguuguccaaccacaaaacggcaggugcacgaccgauggcgugcuccuaggcaccacccaacugucuccugucaacaucugcaccuucagaggagauaucgcccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccagucggugucauccaagaugguggcaccacccaccgaaaugaaccccagcagugggugcucccaaguuacucaggcagaaacacucauaaugugcaucuggcccccgcuguagcccccacuuuuccgggugagcaacuucucuucuucagguccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaaccuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcaguauaa

SEQ ID NO: 5047 - RNA, 1623 nt, Artificial Sequence
  VP1__Norovirus__AGK25892
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucaaucaaaugauuccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaacucaagguuccccauuccuuuggaaaaauuguucacgggccccaguagugccuuugucguucaaccacaaaacggcaggugcacgacugauggcgugcuccuagguaccacccaacugucuccugucaacaucugcacuuucagaggggaugucacccauauuccaggcagucguaacuacacaaugaauuuggccucccaaaauuggaacaguuacgauccaacagaagaaauuccagccccucuaggaacuccagauuucguggggaagauucaagguguacucacccaaaccacaaggacaaauggcucgacccgcggccacaaagcuacaguguacacugggagcgccgacuucucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauucauaaugugcaccuggcccccgcuguagcccccacuuucccgggcgagcagcuucucuucuucagaucuacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuauacacuugcccccaugggaaaugggacggggcguagacgugcauuauaa

SEQ ID NO: 5048 - RNA, 1623 nt, Artificial Sequence
  VP1__Norovirus__AGK25898
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauucucgcggggaacgcguucaccgccggaaaaauuauauuugcagcagucccaccaaauuuuccaacugaaggcuugagucccagucaggucaccauguucccccauauaauaguggauguuaggcaauuggaaccuguguugauccccuuaccugauguuaggaauaauuucuaccacuauaaucagucaaaugauucuaccauuaaauugauagcaaugcuguauacaccacuuagggcuaauaaugcuggggaagaugucuucacagucucuugucgaguucucacgaggccauccccugauuuugauuucauauuuuuggugccaccuacaguugagucaagaacuaagccauuuacugucccaauccuaacuguugaagaaaugaccaacucaagguuccccauuccuuuggagaaguuguucacgggucccagcagugccuuuguuguucaaccacaaaauggcagaugcacaacugauggcgugcucuuagacaccacccagcugucuccuguuaacaucugcaccuucagaggggaugucacccacauugcagguucucguaauuacacaaugaauuuggcuucucuaaauuggaacaacuaugacccaacagaagaaauuccagccccucuaggaacuccagauuucgugggaaagauccaagguaugcucacucaaaccacaaagggagauggcucgacccguggccauaaagcuacaguuuacacugggagugcccccuucacuccaaagcugggcaguguccaauucgaaacugacacagaaaaugauuuugaaacccaccaaaacacaaaauucaccccagucggugucauccaggaugguggcaccacccaccgaaaugaaccucaacaaugggugcucccaaguuauucagguagaaaugucccuaaugcacaccuagccccugcuguagcccccacuuuuccgggugaacaacuccuuuucuuuagguccacuaugcccggaugcagcggguaucccaacauggacuuggacugccugcuaccccaggagugggugcagcacuucuaccaagaggcagcuccagcacaaucugauguggcucuauugagauuugugaauccagacacggguaggguccuguuugagugcaaacuucauaaaucaggcuaugucacagcggcccacaccggccagcaugauuuggucaucccccccaaugguuauuuuagguuugauuccuggguuaaccaauucuacacgcuugcccccaugggaaacggaacggggcguagacgugcuuuguaa

SEQ ID NO: 5049 - RNA, 1623 nt, Artificial Sequence
  VP1__Norovirus__AGK25900
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaacuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauucucgcggggaacgcguucaccgccggaaaaauuauauuugcagcagucccaccaaauuuuccaacugaaggcuugagucccagucaggucaccauguucccccauauaauaguggauguuaggcaauuggaaccuguguugauucccuuaccugauguuaggaauaauuucuaucacuacaaucagucaaaugauucuaccauuaaauugauagcaaugcuguauacgccacuuagggcuaauaaugcuggggaagaugucuuuacagucucuugucgaguucucacgaggccauccccugauuuugauuucauauuuuuggugccaccuacaguugagucaagaacuaagccauuuacugucccaaucuuaacuguugaagaaaugaccaacucaagguuccccauuccuuuggagaaguuguucacgggucccagcagugccuuuguuguucaaccacaaaauggcagaugcacaacugauggcgugcucuuaggcaccacccagcugucuccugucaacaucuguaccuucagaggggaugucacccacauugcagguucucguaauuacacaaugaauucggcuucucuaaauuggaacaauuaugacccaacagaagaaauuccagccccucugggaacuccagauuucgugggaaagauccaagguaugcucacucaaaccacaaagggagauggcucgacgcguggccauaaagcuacaguuuacacugggagugcccccuucacuccaaaguugggcaguguccaauucgaaacugacacagaaaaugauuuugaaacccaccaaaacacaaaauuuaccccagucggugucauccaggaugguggcaccacccaccgaaaugaaccucaacaaugggugcucccaaguuauucagguagaaaugucccuaauguacaccuagccccugcuguagcccccacuuuuccaggugaacaacuccuuuucuuuagguccacuaugcccggaugcagcggguaucccaacauggauuuggauugccugcuaccccaggagugggugcagcacuucuaccaagaggcagcuccagcacaaucugauguggcucuauugagauuugugaauccagacacggguagggucuuguuugagugcaaacuucauaaaucaggcuaugucacaguggcccacaccggccagcaugauuuggucaucccccccaaugguuauuuuagguuugauuccuggguuaaccaauucuacacgcuugcccccaugggaaacggaacggggcguagacgugcuuuguaa

SEQ ID NO: 5050 - RNA, 1623 nt, Artificial Sequence
  VP1__Norovirus__AGK25902
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaccccuaccuaucucauuuggccagaauguauaaugguuaugcaggugguuuugaagugcaggugauucucgcggggaacgcguucaccgccggaaaaauuauauuugcagcagucccaccaaauuuuccaacugaaggcuugagucccagucaggucaccauguucccccauauaauaguggauguuaggcaauuggaaccuguguugauccccuuaccugauguuaggaauaauuucuaccacuauaaucagucaaaugauucuaccauuaaauugauagcaaugcuguauacaccacuuagggcuaauaaugcuggggaagaugucuucacagccucuugucgaguucucacgaggccauccccugauuuugauuucauauuuuuggugccaccuacaguugagucaagaacuaagccauuuacugucccaauccuaacuguugaagaaaugaccaauucaagguuccccauuccuuuggagaaguuguucacgggucccagcagugccuuuguuguucaaccacaaaauggcagaugcacaacugauggcgugcucuuaggcaccacccagcugucuccugucaacaucugcaccuucagaggggaugucacccacauugcagguucucguaauuacacaaugaauuuggcuucucuaaauuggaacaacuaugacccaacagaagaaauuccagccccucuaggaacuccagauuucgugggaaagauccaagguaugcucacucaaaccacaaagggagauggcucgacccguggccauaaagcuacaguuuacacugggagugcccccuucacuccaaagcugggcaguguccaauucgaaacugacacagaaaaugauuuugaaacccaccaaaacacaaaauucaccccagucggugucauccaggaugguggcaccgcccaccgaaaugaaccucaacaaugggugcucccaaguuauucagguagaaaugucccuaauguacaccuagccccugcuguagcccccacuuuuccgggugaacaacuccuuuucuuuagguccacuaugcccggaugcagcggguaucccaacauggacuuggacugccugcuaccccaggagugggugcagcacuucuaccaagaggcagcuccagcacaaucugauguggcucuauugagauuugugaauccagacacggguaggguccuguuugagugcaaacuucauaaaucaggcuaugucacaguggcccacaccggccagcaugauuuggucaucccccccaaugguuauuuuagguuugauuccuggguuaaccaauucuacacgcuugcccccaugggaaacggaacggggcguagacgugcuuuguaa

SEQ ID NO: 5051 - RNA, 1623 nt, Artificial Sequence
  VP1__Norovirus__AGK25905
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuugcacaagccccugguggagaguucacaguguccccuagaaacgcuccaggugaaauacuauggagcgcgcccuuaggcccugaucugaaccccuaccuaucucauuuggccagaauguauaaugguuaugcaggugguuuugaagugcaggugauucucgcggagaacgcguucaccgccggaaaaauuauauuugcagcagucccaccaaauuuuccaacugaaggcuugagucccagucgggucaccauguucccccauauaauaguggauguuaggcaauuggaaccuguguugauccccuuaccugauguuaggaauaauuucuaccacuauaaucagucaaaugauucuaccauuaaauugauagcaaugcuguauacaccacuuagggcuaauaaugcuggggaagaugucuucacagucucuugucgaguccucacgaggccauccccugauuuugauuucauauuuuuggugccaccuacaguugagucaagaacuaagccauuuacugucccaauccuaacuguugaagaaacgaccaauucaagguucccaauuccuuuggagaaguuguucacgggucccagcagugccuuuguuguucaaccacaaaauggcagaugcacaacugauggcgugcucuuaggcaccacccagcugucuccugucaacaucugcaccuucagaggggaugucacccacauugcagguucucguaauuacacaaugaacuuggcuucucuaaauuggaacaacuaugucccaacagaagaaauuccagccccucuaggaacuccagauuucgugggaaagguccaagguaugcucacucaaaccacaaagggagauggcucgacccguggccauaaagcuacaguuuacacugggagugcccccuucacuccaaagcugggcaguguccaauucgaaacugacacagaaaaugauuuugaaacccaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuccucuucuuuagguccacuaugcccggaugcagcggguaucccaacauggacuuggacugccugcuaccccaggagugggugcagcacuucuaccaagaggcagcuccagcacaaucugauguggcucuauugagauuugugaauccagacacggguaggguccuguuugagugcaaacuucauaaaucaggcuaugucacaguggcccacaccggccagcaugauuuggucaucccccccaaugguuauuuuagguucgauuccuggguuaaccaauucuacacgcuugcccccaugggaaacggaacggggcguagacgugcuuuguaa

SEQ ID NO: 5052 - RNA, 1623 nt, Artificial Sequence
  VP1__Norovirus__AGK25908
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauucucgcggggaacgcguucaccgccggaaaaauuauauuugcaacagucccaccaaauuuuccaacugaaggcuugagucccagucaggucaccauguucccccauauaauaguggauguuaggcaauuggaaccuguguugauccccuuaccugauguuaggaauaauuucuaccacuauaaucagucaaaugauucuaccauuaaauugauagcaaugcuguauacaccacuuagggcuaauaaugcuggggaagaugucuucacagucucuugucgaguucucacgaggccauccccugacuuugauuucauauuuuuggugccaccuacaguugagucaagaacuaagccauuuacugucccaauccuaacuguugaagaaaugaccaacucaagguuccccauuccuuuggagaaguuguucacgggucccagcagugccuuuguuguucaaccacaaaauggcagaugcacaacugauggcgugcucuuaggcaccacccagcugucuccuguuaacaucugcaccuucagaggggaugucacccacauugcagguucucguaauuacacaaugaauuuggcuucucuaaauuggaacaacuaugacccaacagaagaaauuccagccccucuaggaacuccagauuucgugggaaagauccaaggugugcucacucaaaccacaaagggagauggcucgacccguggccauaaagcuacaguuuacacugggagugcccccuucacuccaaagcugggcaguguccaauucgaaacugacacagaaaaugauuuugaaacccaccaaaacacaaaauucaccccagucggugucauccaggaugguggcaccacccaccgaaaugaaccucaacaaugggugcucccaaguuauucagguagaaaugucccuaauguacaccuagccccugcuguagcccccacuuuuccgggugaacaacuccuuuucuuuagguccacuaugcccggaugcagcggguaucccaacauggacuuggacugccugcuaccccaggagugggugcagcacuucuaccaagaggcagcuccagcacaaucugauguggcgcuauugagauuugugaauccagacacggguaggguccuguuugagugcaaacuucauaaaucaggcuaugucacaguggcccacaccggucagcaugauuuggucaucccccccaaugguuauuuuagguuugauuccuggguuaaccaauucuacacgcuugcccccaugggaaacggaacggggcguagacgugcuuuguaa

SEQ ID NO: 5053 - RNA, 1623 nt, Artificial Sequence
  VP1__Norovirus__AGK25910
augaagauggcgucgagugacgccaacccaucugauggguccgcagccaaccucgucccagaggucaacaaugagguuauggcucuggagcccguuguuggugccgccauugcggcaccuguagcgggccaacaaaaugugauugaccccuggauuagaaacaauuuuguacaagccccugguggagaguuuacaguguccccuagaaacgcuccaggugaaauacuguggagcgcgcccuuaggcccugaucuaaaucccuaccuuucccauuuggccagaauguacaaugguuaugcaggugguuuugaagugcagguaauucucgcggggaacgcguucaccgccgggaaggucauauuugcagcagucccaucaaauuuuccaacugaaggcuuaagccccagccaggucacuauguucccccauauaauaguagauguuagacaacuagaaccugugcugauccccuuacccgaugucaggaauaauuucuaucauuacaaucaaucaaaugacuccacuauuaaguugauagcaauguuguauacacuacuuagggcuaauaaugcuggggacgaugucuucacaguuucuugccgaguucucacgagaccaucccccgauuuugauuucauauuuuuagugccacccacaguugagucaagaacuaaaccauuuucugucccaguuuuaacuguugaggagaugaccaauucaagauuucccauuccuuuggaaaaguuguucacgggccccagcagugccuuuguuguucaaccacaaaacggcaggugcacgacugauggcgugcuccuaggcaccacccaacugucuccugucaacaucugcaccuucagaggggaugucacccacaucacagguagucguaacuacacaaugaauuuggcuucucaaaauuggaacaauuaugacccaacagaagaaaucccagccccucuagggacuccagauuuuguggggaagauucaaggcaugcucacccaaaccacaaggacagauggcucaacacgcggccacaaagcuacaauguacacugggagcgccgacuuugcuccaaaacuggguagaguucaauuugaaacugacacagaccaugauuuugaagcuaaccaaaacacaaaguucaccccagucgguguuauccaagacgguggcaccacccaccgaaaugaaccccaacagugggugcucccaagcuacucaggcagaaauacucauaaugugcaucuggcccccgcuguagcccccacuuuuccgggugagcaacuucucuucuucagacccaccaugcccggaugcagcggguaccccaacauggauuuggaccgucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacaccggccaacaugauuugguuaucccccccaaugguuauuuuagguuugauuccugggucaaccaguucuacacgcuugcccccaugggaaauggaacggggcguagacguguaguauaa

SEQ ID NO: 5054 - RNA, 1623 nt, Artificial Sequence
  VP1__Norovirus__AGK25912
augaagauggcgucgaaugacgccaacccaucugauggguccgcagccaaccucgucccagaggucgacaaugagguuauggcuuuggagcccguugucggugccgcuauugcggcaccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaccccuaccuaucucauuuggccagaauguauaaugguuaugcaggugguuuugaagugcaggugauucucgcggggaacgcguucaccgccggaaaaauuauauuugcagcagucccaccaaauuuuccaacugaaggcuugagucccagucaggucaccauguucccccauauaauaguggauguuaggcaauuggaaccuguguugauccccuuaccugauguuaggaauaauuucuaccacuauaaucagucaaaugauucuaccauuaaauugauagcaaugcuguauacaccacuuagggcuaauaaugcuggggaagaugucuucacagucucuugucgaguccucacgaggccauccccugauuuugauuucauauuuuuggcgccaccuacaguugagucaagaacuaagccauucacugucccaauccuaacuguugaagaaaugaccaauucaagguucccaauuccuuuggagaaguuguucacgggucccagcagugccuuuguuguucaaccacaaaauggcagaugcacaacugauggcgugcucuuaggcaccacccagcugucucccgucaacaucugcaccuucagaggggaugucacccacauugcagguucucguaauuacacaaugaauuuggcuucucuaaauuggaacaacuaugacccaacagaagaaauuccagccccucuaggaacuccagauuucgugggaaagauccaagguaugcucacucaaaccacaaagggagauggcucgacccguggccauaaagcuacaguuuacacugggagugcccccuucacuccaaagcugggcaguguccaauucgaaacugacacagaaaaugauuuugaaacccaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuccuuuucuuuagguccacuaugcccggaugcagcggguaucccaacauggacuuggacugccugcuaccccaggagugggugcagcacuucuaccaagaggcagcuccagcacaaucugauguggcucuauugagauuugugaauccagacacggguaggguccuguuugagugcaaacuucauaaaucaggcuaugucacaguggcccacaccggccagcaugauuuggucauuccccccaaugguuauuuuagguucgauuccuggguuaaccaauucuacacgcuugcccccaugggaaacggaacggggcguagacgugcuuuguaa

SEQ ID NO: 5055 - RNA, 1623 nt, Artificial Sequence
  VP1__Norovirus__AGK25915
augaagauggcgucgaaugacgccaacccaucugauggguccgcagucaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauucucgcggggaacgcguucaccgccggaaaaauuauauuugcagcagucccaccaaauuuuccaacugaaggcuugagucccagucaagucaccauguucccccauauaauaguggaugcuaggcaauuggaaccuguguugauccccuuaccugauguuaggaauaauuucuaccacuauaaucagucaaaugauucuaccauuaaauugauagcaaugcuguauacaccacuuagggcuaauaaugcuggggaagaugucuucacagucucuugucgaguucucacgaggccauccccugauuuugauuucauauuuuuggugccaccuacaguugagucaagaacuaagccauuuacugucccaauccuaacuguugaagaaaugaccaacucaagguuccccauuccuuuggagaaguuguucacgggucccagcagugccuuuguuguucaaccacaaaauggcagaugcacaacugauggcgugcucuuaggcaccacccagcugucuccuguuaacaucugcaccuucagaggggaugucgcccacauugcagguucucguaauuacacaaugaauuuggcuucucuaaauuggaacaacuaugacccaacagaagaaauuccagccccucuaggaacuccagauuucgugggaaagauccaagguaugcucacucaaaccacaaagggagauggcucgacccguggccauaaagcuacaguuuacacugggagugcccccuucacuccaaagcugggcaguguccaauucgaaacugacacagaaaaugauuuugaaacccaccaaaacacaaaauucaccccagucggugucauccaggaugguggcaccacccaccgaaaugaaccucaacaaugggugcucccaaguuauucagguagaaaugucccuaauguacaccuagccccugcuguagcccccacuuuuccgggugaacaacuccuucucuuuagguccacuaugcccggaugcagcggguaucccaacauggacuuggacugccugcuaccucaggagugggugcagcacuucuaccaagaggcagcuccagcacaaucugauguggcucuauugagauuugugaauccagacacggguaggguccuguuugagugcaaacuucauaaaucaggcuaugucacaguggcccacaccggccagcaugauuuggucaucccccccagugguuauuuuagguuugauuccuggguuaaccaauucuacacgcuugcccccaugggaaacggaacggggcguagacgugcuuuguaa

SEQ ID NO: 5056 - RNA, 1623 nt, Artificial Sequence
  VP1__Norovirus__AGK25917
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaccccuaccuaucucauuuggccagaauguauaaugguuaugcaggugguuuugaagugcaggugauucucgcggggaacgcguucaccgccggaaaaauuauauuugcagcagucccaccaaauuuuccaacugaaggcuugagucccagucaggucaccauguucccccauauaauaguggauguuaggcaauuggaaccuguguugauccccuuaccugauguuaggaauaauuucuaccacuauaaucagucaaaugauucuaccauuaaauugauagcaaugcuguauacaccacuuagggccaauaaugcuggggaagaugucuucacagucucuugucgaguucucacgaggccauccccugauuuugauuucauauuuuuggugccaccuacaguugagucaagaacuaagccauuuacugucccaauccuaacuguugaagaaaugaccaauucaggguuccccauuccuuuggagaaguuguucacgggucccagcagugccuuuguuguucaaccacaaaacggcagaugcacaacugauggcgugcucuuaggcaccacccagcugucuccugucaacaucugcaccuucagaggggaugucacccacauugcagguucucguaauuacacaaugaauuuggcuucucuaaauuggaacaacuaugacccaacagaagaaauuccagccccucuaggaacuccagauuucgugggaaagguccaaggugugcucacucaaaccacaaagggagauggcucgacccguggccauaaagcuacaguuuacacugggagugcccccuucacuccaaagcugggcaguguccaauucgaaacugacacagaaaaugauuuugaaacccaccaaaacacaaaauucaccccagucggugucauccaggaugguggcaccgcccaccgaaaugaaccucaacaaugggugcucccaaguuauucagguagaaaugucccuaauguacaccuagccccugcuguagcccccacuuuuccgggugaacaacuccuuuucuuuagguccacuaugccgggaugcagcggguaucccaacauggacuuggacugccugcuaccccaggagugggugcagcacuucuaccaagaggcagcuccagcacaaucugauguggcucuauugagauuugugaauccagacacggguaggguccuguuugagugcaaacuucauaaaucaggcuaugucacaguggcccacaccggccagcgugauuuggucaucccccccaaugguuauuuuagguuugauuccuggguuaaccaauucuacacgcuugcccccaugggaaacggaacggggcguagacgugcuuuguaa

SEQ ID NO: 5057 - RNA, 1623 nt, Artificial Sequence
  VP1__Norovirus__AGK25919
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuaggaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccaccuacaguugagucaagaacuaaaccauucucugucccaguuuuaacuguugaggagaugaccaauucaagauuccccaucccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaccccagccccucuaggaacuccagauuuuguggggaagauucaaggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacauucugauguggcucugcuaagauuugugaacccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaguggaacggggcguagacgugcaguauaa

SEQ ID NO: 5058 - RNA, 1623 nt, Artificial Sequence
  VP1__Norovirus__AGK25921
augaagauggcgucgagugacgccaacccaucugauggguccgcagccaaccucgucccagaggucaacaaugagguuauggcucuggagcccguugcuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguaugcaccacuuagggcuaauaaugcuggggaugaugucuucacaguuucuugccgaguucucacgagaccaucccccgauuuugauuuuauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcaguauaa

SEQ ID NO: 5059 - RNA, 1623 nt, Artificial Sequence
  VP1__Norovirus__AGK25924
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaagucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguccacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucagggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcaguauaa

SEQ ID NO: 5060 - RNA, 1623 nt, Artificial Sequence
  VP1__Norovirus__AGK25927
augaagauggcgucgagugacgccaacccaucugauggguccgcagccaaccucgucccagaggucaacaaugagguuauggcucuggagcccguuguuggugccgccauugcggcaccuguagcgggccaacaaaacguaauugaccccuggauuagaaauaauuuuguacaagccccugguggagaguuuacaguauccccuaggaacgcuccaggugaaauacuauggagcgcgcccuugggcccugaucuaaaucccuaccuaucccauuuggccagaauguauaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguaugcaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccaucccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccggccccucuaggaacuccagauuuuguggggaagauucaaggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccaguuggugucauccaagaugguggcaccacccaccgaaacgaaccccaacagugggugcucccaagcuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccaaacacagguaggguuuuguuugaguguaagcuucauaaaucaggcuauguuacaguggcucacacuggccaacaugauuugguuaucccccccaaugauuauuuuagguuugauuccugggucaaccaguuuuacacgcuugcccccaugggaaauggaacggggcguagacgugcaguauaa

SEQ ID NO: 5061 - RNA, 1623 nt, Artificial Sequence
  VP1__Norovirus__AGK25930
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuggaaccuguguugauucccuuacccgauguugggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggagaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuuugcuccaaaacuggguagaguacaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcaguauaa

SEQ ID NO: 5062 - RNA, 1623 nt, Artificial Sequence
  VP1__Norovirus__AGS08025
augaagauggcgucgagugacgccaacccaucugauggguccacagccaaccucgucccagaggucaacaaugagguuauggcuuuggagcccguaguuggugccgcuauugcggcaccuguagcgggccaacaaaauguaauugaccccuggauuaggaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuagacaauuggaaccuguguugaucccuuuacccgauguuaggaauaauuucuaccacuauaaucaaucaaaugaccccacuaucaaauugauagcaauguuguacacaccacuuagggcuaauaaugccggggaugaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguuuacgggcccuaguagugccuuuguuguucaaccacaaaacggcaggugcacgacugauggcgugcuccuaggcaccacccaacuguccccagucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaacaacaaagacaaauggcucgacucgcggccacaaagcuacaguguacacugggagcgccgacuuuucuccaaaacuggguagaguucaauuugccacugacacagacaaugauuuugaaacuaaccaaaacacaaaguuuaccccagucgguguuauccaggaugguaguaccaccccucgaaaugaaccccaacaaugggugcucccaaguuacucaggcagaaacauucauaaugugcaccuggcccccgcuguggcccccacuuucccgggcgagcagcuccucuucuucagaucuacuaugcccgggugcagcggguaccccaacauggauuuggacugccugcucccccaggagugggugcaguacuucuaccaggaggcagccccagcacaaucugacguggcuuuguuaagauuugugaauccagacacagguaggguuuuguuugaguguaagcuucauaaaucaggcuauguuacaguggcucacacuggccaacaugauuugguuaucccccccaaugguuacuuuagauuugauuccugggucaaccaguucuacacacuugcccccaugggaaaugggacggggcguagacgugcauuauaa

SEQ ID NO: 5063 - RNA, 1623 nt, Artificial Sequence
  VP1__Norovirus__AGS08026
augaagauggcgucgagugacgccaacccaucugauggguccacagccaaccucgucccagaggucaacaaugagguuauggcuuuggagcccguaguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugauuugaaucccuaccuuucccauuuggccagaauguacaaugguuaugcaggugguuuugaagugcagguaauccucgcggggaaugcguucaccgcugggaaaaucauauuugcagcagucccaccaaauuucccaacugaagguuugagccccagccaagucacuauguucccccauauaauaguagauguuaggcaauuggaaccuguguugauccccuuacccgauguuaggaauaauuucuaccauuauaaucagucaaaugaccccaccaucaaauugauagcaauguuguacacaccacuuagggcuaauaaugccggggacgaugucuucacaguuucuugucgaguucucacgagaccaucccccgauuuugauuucauauuuuugguaccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucuguaccuucagaggggaugucacccacauuucaggcagucguaacuacacaaugaauuuggccucccaaaauuggaacaguuacgauccaacagaagaaaucccagccccccuaggaacuccagauuucguggggaagauucaaggugugcucacccaaaccacaagaacagauggcucgacccgcggccacaaagcuacaguguacacugggagcgccgacuuuucuccaaaacuggguaggguucaauuugccacugacacagacaaugauuuuguaacuaaccaaaacacaaaguucaccccagucgguguuauccaggaugguagcacuaccccccgaaaugaaccccaacaaugggugcucccaaguuacucaggcagaaacacucauaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguuaagguuugugaauccagacacagguaggguuuuguuugagugcaagcuucauaaaucaggcuauguuacaguggcucauacuggccaacaugauuuaguuaucccccccaauggcuauuuuagauuugauuccugggucaaccaguucuacacacuugcccccaugggaaaugggacggggcguagacgugcauuauaa

SEQ ID NO: 5064 - RNA, 1623 nt, Artificial Sequence
  VP1__Norovirus__AGS08027
augaagauggcgucgagugacgccaacccaucugauggguccacagccaaccucgucccagaggucaacaaugagguuauggcuuuggagcccgugguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugacuugaaucccuaccuuucccaucuggccagaauguauaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagaugucaggcaguuggaaccuguguugauccccuuacccgauguuaggaauaauuucuaccauuauaaucaaucaaaugauuccaccaucaaauugauagcaauguuguacacaccacuuagggcuaauaaugccggggaugaugucuucacaguuucuugucgaguucuuacgagaccaucccccgauuuugauuuuauauuuuuggugccacccacaguugaaucaagaacuaaaccauucucugucccaauuuuaacuguugaggagaugaccaauucaagguuccccauuccuuuggaaaaguuguucacgggccccaguagugccuuuguuguucaaccacaaaacggcaggugcacgacugauggcgugcuccuagguaccacucaacuaucuccugucaacaucugcaccuucagaggggacgucacccauauuccaggcagucauaacuacacaaugaauuuggccucccaaaauuggaacaguuacgauccaacagaagaaaucccagccccucuaggaacuccagauuucguggggaagauucaaggugugcucacucaaaccacuagugcaaauggcucgacccgcggccacaaagcuacaguguacacugggagcgccgacuuuucuccaaaacugggcagaguucaguuugccacugacacaaacaaugauuuugaaacuaaccaaaacacaaaauucaccccagucggcguuauccaggaugguaauacuaccccccgaaaugaaccccaacaaugggugcucccaaguuacucaggcagaaacauucacaaugugcaccuggcccccgcuguggcccccacuuucccgggcgaacagcuccucuucuucagaucuacuaugcccggaugcagcggguaccccaacauggauuuggauugucugcucccccaggaaugggugcaguacuucuaccaggaggcagccccagcacaaucugauguggcccuguuaagauuugugaauccagacacagguaggguuuuguuugaguguaagcuucauaaaucaggcuauguuacaguggcucauacuggccagcaugauuugguuaucccccccaaugguuauuuuagauuugacuccugggucaaccaguucuacacacuugcccccaugggaaaugggacggggcguagacgugcauuauaa

SEQ ID NO: 5065 - RNA, 1623 nt, Artificial Sequence
  VP1__Norovirus__AGS08028
augaagauggcgucgagugacgccaacccaucugauggguccgcagccaaccucgucccagaggucaacaaugagguuauggcucuggagcccguuguuggugccgccauugcggcgccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacaagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaauuccagccccucuaggaacuccagauuuuguggggaagauucaaggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccagucggugucauccaagaugguggcaccacccaccgaaaugaaccccaacagugggugcucccaaguuacucaggcagaaacacucauaaugugcaucuggcucccgcuguagcccccacuuuuccgggugagcaacuucucuucuucagauccaccaugcccggaugcagcggguaccccaacauggauuuggacugucugcucccccaggaaugggugcaguacuucuaccaagagacagccccagcacaaucugauguggcucugcuaagauuugugaauccagacacagguaggguuuuguuugaguguaagcuucauaaaucaugcuauguuacaguggcccacacuggccaacaugauuugguuaucccccccaaugguuauuuuagguuugauuccugggucaaccaguuuuacacgcuugcccccaugggaaauggaacggggcguagacgugcaguauaa

SEQ ID NO: 5066 - RNA, 1623 nt, Artificial Sequence
  VP1__Norovirus__AGS08029
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuugugcaagccccugguggagaguuuacaguauccccuagaaacgcuccaggugaaauacuauggagcgcgcccuuaggcccugauuugaaucccuaccuuucccauuuggccagaauguacaaugguuaugcagguggcuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaauggcaggugcacgacugauggcgugcuccuagguacuacccaacuguccccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucauaaugugcaccuggcccccgcuguagcccccacuuucccgggcgagcagcuccucuucuucagauccacuaugcccggaugcagcggguaccccaacauggauuuggacugucugcucccccaggaaugggugcaguauuucuaccaagaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 5067 - RNA, 1623 nt, Artificial Sequence
  VP1__Norovirus__AGS08030
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccuggcggagaguuuacaguauccccuagaaacgcuccaggugaaauacuauggagcgcgcccuuaggcccugauuugaaucccuaccuuucccauuuggccagaauguacaaugguuaugcagguggcuuugaagugcagguaauccucgcggggaaugcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaauggcaggugcacgacugauggcgugcuccuagguacuacccaacuguccccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucauaaugugcaccuggcccccgcuguagcccccacuuucccgggcgagcagcuccucuucuucagauccacuaugcccggaugcagcggguaccccaacauggauuuggacugucugcucccccaggaaugggugcaguauuucuaccaagaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 5068 - RNA, 1623 nt, Artificial Sequence; identical to SEQ ID NO: 5067
  VP1__Norovirus__AGS08031

SEQ ID NO: 5069 - RNA, 1623 nt, Artificial Sequence
  VP1__Norovirus__AGS08032
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugacuccacuaucaaauugauagcaauguuguauacaccacuuagggcuaauaaugccggggacgaugucuucacaguuucuugucgaguucucacgagaccaucccccgauuuugauuuuauauuuuuggugccacccacaguugaaucaagaacuaaaccauucucugucccaguuuuaacuguugaggagaugaccaauucaagguuccccauuccuuuggaaaaguuguucacgggccccagcagugccuuuguuguucaaccacaaaacggcaggugcacgacugauggcgugcuccuagguacuacccaauugucuccugucaacaucugcaccuucagaggggaugucacccauauuccaggcagucguaacuacacaaugaauuuggccucccaaaacuggaacaguuacgauccaacagaagaaaucccagccccucuaggaacuccagauuuuguggggaaaauucaaggugugcucacccaaaccacaaggacaaauggcucgacccgcggccacaaagccacaguguacacugggagcgccgacuuuucuccaaaacuggguaggguucaauuugccacugacacagacaaugauuuugaaacuaaccaaaacacaaaguucaccccagucggcguuauccaggaugguagcacuaccccccgaaaugaaccccaacaaugggugcucccaaguuacucaggcagaaacauucacaaugugcaccuggcccccgcuguagcccccacuuucccgggcgagcagcuccucuucuucagaucuaccaugcccggaugcagcggguaccccaacauggacuuggacugccugcucccccaggaaugggugcaguacuucuaccaggaggcagccccagcacaaucugauguggcucuguugagauuugugaauccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacgugcauuauaa

SEQ ID NO: 5070 - RNA, 1623 nt, Artificial Sequence
  VP1__Norovirus__AGS08033
augaagauggcgucgagugacgccaacccaucugauggguccguagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacaagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagccguaacuacacaaugaauuuggcuucucaaaauuggaacaauuaugacccaacagaagaaauuccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccagucggugucauccaagaugguggcaccacccaccgaaaugaaccccaacagugggugcucccaaguuacucaggcagaaacacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcccacacuggccaacaugauuugguuaucccccccaaugguuauuuuagguuugauuccugggucaaccaguuuuacacgcuugcccccaugggaaauggaacggggcguagacgugcaguauaa

SEQ ID NO: 5071 - RNA, 1623 nt, Artificial Sequence
  VP1__Norovirus__AGS08035
augaagauggcgucgagugacgccaacccaucugauggguccacagccagccucgucccagaggucaacaaugagguuauggcguuggagcccguaguuggugccgccauugcggcaccuguagcgggccaacaaaauguaauugaccccuggauuagaaacaauuuuguacaagccccugguggagaguucacaguaucccccagaaacgcuccaggugaaauacuauggagcgcgcccuuaggcccugaucugaaucccuaccuuucccauuuggccagaauguacaauaguuaugcaggugguuuugaagugcaaguaauccucgcggggaacgcguucaccgccgggaaaaucauauuugcagcagucccaccaaauuucccaacugaagguuugagccccagccaggucaccauguucccccacauaauaguagauguuaggcaauuggaaccuguguuaauucccuuacccgauguuaggaauaauuucuaucauuauaaccagucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccagcugucucccgucaacaucugcaccuucagaggggaugucacccauauuucaggcagccacaacuacacaaugaauuuggccucccaaaauuggaacaguuacgacccaacagaagaaaucccagccccucuagggacuccagauuucguggggaagauucaaggugugcucacccaaaccacaaggauaaauggcucgacccgcggucacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccucaacaaugggugcucccuaguuacucaggcagaaacacucauaacgugcaccuggcccccgcuguagcccccacuuucccgggcgagcagcuccucuucuucagauccacuaugcccggaugcagcggguaccccaacauggacuuggacugucugcucccccaggaaugggugcaguauuucuaccaggaggcagccccagcacaaucugauguggcucugcugagauuugugaacccagacacagguagggucuuguuugaguguaagcuccauaaaucaggcuauguuacaguggcucacacuggccaacaugauuugguuaucccccccaaugguuauuucagauuugauuccugggucaaccaguucuacacacuugcccccaugggaaaugggacggggcguagacgugcauuauaa

SEQ ID NO: 5072 - RNA, 1623 nt, Artificial Sequence
  VP1__Norovirus__AGS08036
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguucaagccccugguggagaguucacaguauccccuagaaacgcuccaggugaaauacuauggagcgcgcccuuaggcccugacuugaaucccuaccuuucccauuuggccagaauguacaaugguuaugcaggugguuuugaagugcaggugauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaucauuauaaucagucaaaugaccccacuaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauccccuuggagaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgacccaacagaagaaaucccagccccccugggaacuccagauuucguggggaagauucaaggcgugcucacccaaaccacaaggacagauggcucgacccgcggccacaaagcuacaguguacacugggagcgccgacuuuucuccaaaacuggguaggguucaauuugccacugacacagacaaugauuuuguaacuaaccaaaacacaaaguucaccccagucgguguuauccaggaugguaguacuaccccccgaaaugaaccccaacaaugggugcuuccaaguuacucaggcagaaacacucauaaugugcaccuggcccccgcuguggcccccacguucccgggcgagcagcuccucuucuucagaucuaccaugcccggaugcagcggguaucccaacauggauuuggacugucugcucccccaggaaugggugcaguauuucuaccaggaggcagccccagcacaaucugauguggcacuguugagauuuguaaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacgugcauuauaa

SEQ ID NO: 5073 - RNA, 1623 nt, Artificial Sequence
  VP1__Norovirus__AGS08037
augaagauggcgucgagugacgccaacccaucugauggguccacagccaaccucgucccagaggucaacaaugagguuauggcuuuggagcccguaguuggugccgccauugcggcaccuguggcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcagguggcuuugaagugcagguaauccucgcggggaacgcguucaccgccgggaaaaucauauuugcagcagucccaccaaauuucccaaccgaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaagccauucucugucccaguuuuaacuguugaggagaugaccaauucaagguuccccaucccuuuggaaaaguuguucacgggccccaguagugccuuuguuguucaaccacaaaauggcaggugcacgacugauggcgugcuccuagguacuacccaacuguccccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugcuacugacacagacaaugauuuugaaacuaaccaaaacacaaaguucaccccagucgguguuauccaggaugguaguaccaccccccgaaaugaaccccaacaaugggugcucccaaguuacucagguagaaacauucauaaugugcaccuggcccccgcuguagcccccacuuucccgggcgagcagcuccucuucuucagauccacuaugcccggaugcagcggguaccccaacauggauuuggacugucugcucccccaggaaugggugcaguauuucuaccaagaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 5074 - RNA, 1623 nt, Artificial Sequence
  VP1__Norovirus__AGS08038
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuaggaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccggaaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacaagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaauuccagccccucuaggaacuccagauuuuguggggaagauucaaggcgugcucacccaaaccacaaggacagauggcucaacacgcggccacaaagcuacaguguacacugggagcgccgacuuugccccaaaacuggguagaguucaauuugaaacugacacagaccaugauuuugaugcuaaccaaaacacaaaguucaccccagucggugucauccaagaugguggcaccacccaccgaaaugaaccccaacagugggugcucccaaguuacucaggcagaaacacucauaaugugcaucuggcucccgcuguagcccccacuuuuccgggugagcaacuucucuucuucagauccaccaugcccggaugcagcggguaccccaacauggauuuggacuguuugcucccccaggaaugggugcaguacuucuaccaggaggcagccccagcacaaucugauguggcucugcuaagauuugugaauccagacacagguaggguuuuguuugaguguaagcuucauaaaucaggcuauguuacaguggcccacacuggccaacaugauuugguuaucccccccaaugguuauuuuagguuugauuccugggucaaccaguuuuacacgcuugcccccaugggaaauggaacggggcguagacgugcaguauaa

SEQ ID NO: 5075 - RNA, 1623 nt, Artificial Sequence
  VP1__Norovirus__AGS08040
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaauuggaaccuguguugauucccuuacccgauguuaggaauaauuucuaccauuauaaucaaucaaaugaucccaccaucaaauugauagcaauguuguacacaccacuuagggcuaauaaugccggggacgaugucuucacaguuuccugucgaguucucacgagaccaucccccgauuuugauuucauauuuuuggugccacccacaguugaaucaagaacuaaaccauucucugucccaguuuuaacuguugaggagaugaccaacucaagguuccccauuccuuuggaaaaguuguucacaggccccaguagugccuuuguuguucaaccacaaaacggcaggugcacgacugauggcgugcuccuagguacuacccaacugucuccugucaacaucugcaccuuuagaggggaugucacccauauuccaggcagucguaacuacacaaugaauuuggccucccaaaauuggaacaguuacgacccaacagaagaaaucccagccccucuaggaacuccagauuucguggggaagauucaaggugugcucacccaaacuacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauccauaaugugcaccuggcccccgcuguagcccccacuuucccgggcgaacagcuccucuucuucagaucuacuaugcccggaugcagcggguaccccaacauggauuuggacugucugcucccccaggaaugggugcaguauuucuaccaggaggcagccccagcacaaucugauguggcucuguuaagauuugugaauccagacacagguaggguuuuguuugaguguaagcuccauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 5076 - RNA, 1623 nt, Artificial Sequence
  VP1__Norovirus__AGS08041
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguucaagccccugguggagaguucacaguauccccuagaaacgcuccaggugaaauacuauggagcgcgcccuuaggcccugacuugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaucauuauaaucagucaaaugaccccacuaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauccccuuggaaaaguuguucacgggccccaguagugccuuuguuguucaaccacaaaacggcaggugcacgacugauggcgugcuccuagguacuacccaacuguccccugucaacaucugcaccuucagaggggaugucacccacauuucaggcagucguaacuacacaaugaauuuggccucccaaaauuggaacaguuacgacccaacagaagaaaucccagccccccugggaacuccagauuucguggggaagauucaaggcgugcucacccaaaccacaaggacagauggcucgacccgcggccacaaagcuacaguguacacugggagcgccgacuuuucuccaaaacuggguaggguucaauuugccacugacacagacaaugauuuuguaacuaaccaaaacacaaaguucaccccagucgguguuauccaggaugguaguacuaccccccgaaaugaaccccaacaaugggugcuuccaaguuacucaggcagaaacacucauaaugugcaccuggcccccgcuguggcccccacguucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacgugcauuauaa

SEQ ID NO: 5077 - RNA, 1623 nt, Artificial Sequence
  VP1__Norovirus__AGS08042
augaagauggcgucgagugacgccaacccaucugauggguccacagccaaccucgucccagaggucaacaaugaggucauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggucugagccccagccaggucacuauguucccccacauaauaguagauguuaggcaauuggaaccuguguugauccccuuacccgauguuaggaauaauuuuuaccauuauaaucaaucaaaugacuccaccaucaaauugauagcaauguuguacacaccacuuagggcuaauaaugccggggacgaugucuucacaguuucuugucgaguucucacgagaccaucccccgauuuugauuuuauauuuuuggugccacccacaguugaaucaagaacuaaaccauucuccgucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaauugucuccugucaacaucugcaccuucagaggggaugucacccacauuccaggcagucguaacuacacaaugaauuuggccucccaaaacuggaacaguuacgauccaacagaagaaaucccagccccucuaggaacuccagauuuuguggggaaaauucaaggugugcucacccaaaccacaaggacaaauggcucgacccgcggccacaaagcuacaguguacacugggagcgccgacuuuucuccaaaauuggguaggguucaauuugccacugacacagacaaugauuuugaaacuaaccaaaacacaaaguucaccccagucggcguuauccaggaugguagcacuaccccccgaaaugaaccccaacaaugggugcucccaaguuacucaggcagaaacauucacaaugugcaccuggcccccgcuguagcccccacuuucccgggcgagcagcuccucuucuucagaucuacuaugcccggaugcagcggguaccccaacauggacuuggacugucugcucccccaggaaugggugcaguacuucuaccaggaggcagccccagcacagucugacguggcucuguuaagauuugugaauccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacgugcauuauaa

SEQ ID NO: 5078 - RNA, 1623 nt, Artificial Sequence
  VP1__Norovirus__AGS08043
augaagauggcgucgagugacgccaacccaucugauggguccacagccaaccucgucccagaggucagcaaugagguuauggcuuuggagcccgugguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugacuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagaugucaggcaauuggaaccuguguugauccccuuacccgauguuaggaauaauuucuaccauuauaaucaaucaaaugacuccaccaucaaauugauagcaauguuguacacaccacuuagggcuaauagugccggggaugaugucuucacaguuucuugucgaguucuuacgagaccaucccccgauuuugauuuuauauuuuuggugccacccacaguugaaucaagaacuaaaccauucucugucccaauuuuaacuguugaggagaugaccaauucaagguuccccauuccuuuggaaaaguuguucacgggccccaguagugccuuuguuguucaaccacaaaacggcaggugcacgacugauggcgugcuccuagguaccacucaacuaucuccugucaacaucugcaccuucagaggggacgucacccauauuccaggcagucauaacuacacaaugaauuuggccucccaaaauuggaacaguuacgauccaacagaagaaaucccagccccucuaggaacuccagauuucguggggaagauucaaggugugcucacucaaaccacuaguacaaauggcucgacccgcggccacaaagcuacaguguacacugggagcgccgacuuuucuccaaaacugggcagaguucaguuugccacugacacaaacaaugauuuugaaacuaaccaaaacacaaaauucaccccagucggcguuauccaggaugguaguacuaccccccgaaaugaaccccaacaaugggugcucccaaguuacucaggcagaaacauucacaaugugcaccuggcccccgcuguggcccccacuuucccgggcgaacagcuccucuucuucagaucuacuaugcccggaugcagcggguaccccaacauggauuuggauugucugcucccccaggaaugggugcaguacuucuaccaggaggcagccccagcacaaucugauguggcccuguuaagauuugugaauccagacacagguaggguuuuguuugaguguaagcuucauaaaucaggcuauauuacaguggcucauacuggccagcaugauuugguuaucccccccaaugguuauuuuagauuugacuccugggucaaccaguucuacacacuugcccccaugggaaacgggacggggcguagacgugcauuauaa

SEQ ID NO: 5079 - RNA, 1623 nt, Artificial Sequence
  VP1__Norovirus__AGS08044
augaagauggcgucgagugacgccaacccaucugauggguccacagccaaccucgucccagaggucaacaaugagguuauggcuuuggagcccgugguuggugccgccauugcggcaccuguagcgggccaacaaaauguaauugaccccuggauuagaaacaauuuuguacaagccccugguggagaguucacaguuuccccuagaaacgcuccaggugaaauacuauggagcgcgcccuuaggcccugacuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagaugucaggcaauuggaaccuguguugauccccuuacccgauguuaggaauaauuucuaccauuauaaucaaucaaaugauuccaccaucaaauugauagcaauguuguacacaccacuuagggcuaauaaugccggggaugaugucuucacaguuucuugucgaguucuuacgagaccaucccccgauuuugauuuuauauuuuuggugccacccacaguugaaucaagaacuaaaccauucucugucccaauuuuaacuguugaggagaugaccaauucaagguuccccauuccuuuggaaaaguuguucacgggccccaguagugccuuuguuguucaaccacaaaacggcaggugcacgacugauggcgugcuccuagguaccacucaacuaucuccugucaacaucugcaccuucagaggggacgucacccauauuccaggcagucauaacuacacaaugaauuuggccucccaaaauuggaacaguuacgauccaacagaagaaaucccagccccucuaggaacuccagauuucguggggaagauucaaggugugcucacucaaaccacuaguacaaauggcucgacccgcggccacaaagcuacaguguacacugggagcgccgacuuuucuccaaaacugggcagaguucaguuugccacugacacaaacaaugauuuugaaacuaaccaaaacacaaaauucaccccagucggcguuauccaggaugguaguacuaccccccgaaaugaaccccaacaaugggugcucccaaguuacucaggcagaaacauucacaaugugcaccuggcccccgcuguggcccccacuuucccgggcgaacagcuccucuucuucagaucuacuaugcccggaugcagcggguaccccaacauggauuuggauugucugcucccccaggaaugggugcaguacuucuaccaggaggcagccccagcacaaucugauguggcccuguuaagauuugugaauccagacacagguaggguuuuguuugaguguaagcuucauaaaucaggcuauguuacaguggcucauacuggccagcaugauuugguuaucccccccaaugguuauuuuagauuugacuccugggucaaccaguucuacacacuugcccccaugggaaaugggacggggcguagacgugcauuauaa

SEQ ID NO: 5080 - RNA, 1623 nt, Artificial Sequence
  VP1__Norovirus__AGS08045
augaagauggcgucgagugacgccaacccaucugauggguccacagccaaccucgucccagaggucaacaaugagguuauggcucuugagcccguaguuggugccgcuauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggucugagccccagccaggucacuauguucccccauauaauaguagauguuaggcaauuggaaccuguguugauccccuuacccgauguuaggaauaauuucuaccacuauaaucaaucaaaugaccccaccaucaaauugauagcaauguuguacacaccacuuagggcuaauaaugccggggaugaugucuucacaguuucuugucgaguucucacgagaccaucccccgauuuugacuuuauauuuuuggugccacccacaguugaaucaagaacuaaaccauucucugucccaguuuuaacuguugaggagaugaccaauucaagguuccccguuccuuuggaaaaguuguucacgggccccaguagugccuuuguuguucaaccacaaaacggcaggugcacgacugauggcgugcuccuagguacuacccaacuguccccugucaacaucugcaccuucagaggggaugucacccauauuacaggcagucguaacuacacaaugaauuuagccucccaaaauuggaacaguuacgauccaacagaagaaaucccagccccucuaggaacuccagauuucguggggaagauucaaggugugcucacccaaacaacaaggacgaauggcucgacucgcggccacaaagcuacaguguacacugggagcgccgacuuuucuccaaaacuggguagaguucaauuugccacugacacagacaaugauuuugaaacuaaccaaaacacaaaguuuaccccagucgguguuauccaggaugguaguacuaccccccgaaaugaaccccaacaaugggugcucccaaguuacucaggcaggaacauucauaaugugcaccuggcccccgcuguggcccccacuuucccgggcgagcagcuucucuucuucagaucuacuaugcccggaugcagcggguaccccaacauggauuuggacugccugcucccccaggaaugggugcaguacuucuaccaggaggcagccccagcacaaucugacguggcucuguuaagauuugugaauccagacacagguaggguuuuguuugaguguaagcuucauaaaucaggcuaugucacaguggcucacacuggccaacaugauuugguuaucccccccaaugguuauuuuagauuugauuccuggguuaaccaguucuacacacuugcccccaugggaaaugggacggggcguaggcgugcauuauaa

SEQ ID NO: 5081 - RNA, 1623 nt, Artificial Sequence
  VP1__Norovirus__AGS08047
augaagauggcgucgagugacgccaacccaucugauggguccacagccaaccucgucccagaggucaacaaugagguuauggcuuuggagcccguagucggugccgcuauugcggcaccuguagcgggccagcaaaauguaauugaccccuggauuagaaacaauuuuguucaagccccugguggagaguucacaguauccccuagaaacgcuccaggugaaauacuauggagcgcgcccuuagguccugacuugaaucccuaccuuucccauuuggccagaauguacaauaguuaugcaggugguuuugaagugcagguaauccucgcggggaaugcguucaccgccgggaaaaucauauuugcagcagucccaccaaacuucccaacugaagguuugagccccagccaagucacuauguucccccacauaauaguagauguuaggcaauuggaaccuguguugauccccuugcccgauguuaggaauaauuucuaucauuauaaucagucaaaugaccccacuaucaaauugauagcaauguuguacacaccgcuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgacccaacagaagaaaucccagccccccuaggaacuccagauuucguggggaagauucaaggcgugcucacccaaaccacaaggacagauggcucgacccgcggccacaaagcuacaguguacacugggagcgccgacuuuucuccaaaacuggguaggguucaauuugccacugacacagacaaugauuuuguaacuaaccaaaacacaaaauucaccccagucgguguuauccaggaugguaguaccaccccccgaaaugaaccccaacaaugggugcuuccaaguuacucaggcagaaacacucauaaugugcaccuggcccccgcuguagcccccacguucccgggcgagcagcuccucuucuucagaucuaccaugcccggaugcagcggguaccccaacauggauuuggacugucugcucccccaggaaugggugcaguauuucuaccaggaggcagccccggcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacgugcauuauaa

SEQ ID NO: 5082 - RNA, 1623 nt, Artificial Sequence
  VP1__Norovirus__AGS08048
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguucaagccccugguggagaguucacaguauccccuagaaacgcuccaggugaaauacuauggagcgcgcccuuaggcccugacuugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaucauuauaaucagucaaaugaccccacuaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauccccuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgacccaacagaagaaaucccagccccccugggaacuccagauuucguggggaagauucaaggcgugcucacccaaaccacaaggacagauggcucgacccgcggccacaaagcuacaguguacacugggagcgccgacuuuucuccaaaacuggguaggguucaauuugccacugacacagacaaugauuuuguaacuaaccaaaacacaaaguucaccccagucgguguuauccaggaugguaguacuaccccccgaaaugaaccccaacaaugggugcuuccaaguuacucaggcagaaacacucauaaugugcaccuggcccccgcuguggcccccacguucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacgugcauuauaa

SEQ ID NO: 5083 - RNA, 1623 nt, Artificial Sequence
  VP1__Norovirus__AGS08050
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuauaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcuuccaaguuacucaggcagaaauacuccuaaugugcaucuggcccccgcuguagcccccacuuuuccgggugagcaacuucucuucuucagauccaccaugcccggaugcagcggguaccccaacauggacuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5084 - RNA, 1623 nt, Artificial Sequence
  VP1__Norovirus__AGS08051
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacuauggagcgcgcccuuaggcccugaucugaaucccuaccuuucccauuuggccagaauguacaaugguuaugcaggugguuuugaagugcagguaauccucgcggggaaugcguucaccgccggaaaaaucauauuugcagcagucccaccaaauuucccaacugaagguuugagccccagccaagucacuauguucccccacauaauaguagauguuaggcaauuggaaccuguguugauccccuuacccgauguuagaaauaauuucuaccauuauaaucagucaaaugaccccaccaucaaauugauagcaauguuguacacaccacuuagggcuaacaaugccggggacgauguauucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcgccuucagaggggaugucacccacauuucaggcagucguaacuacacaaugaauuuggccucccaaaauuggaacaguuaugauccaacagaagaaaucccagccccccuaggaacuccagauuucguggggaagauucaagguaugcucacccaaaccacaaggacagauggcucgacccgcggccacaaagcuacaguguacacugggagcgccgacuuuucuccaaaacuggguaggguucaauuugccacugacacagacaaugauuuuguaacuaaccaaaacacaaaguucaccccagucgguguuauccaggaugguaguacuaccccccgaaaugaaccccaacaaugggugcuuccaagcuacucaggcagaaacacucauaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacgugcauuauaa

SEQ ID NO: 5085 - RNA, 1623 nt, Artificial Sequence
  VP1__Norovirus__AGS08052
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauauuguggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuauaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuuggaacugacacagaccaugauuuugaagcuaaccaaaacacaaaguucaccccaguuggugucauccaagaugguagcaccacccaccgaaaugaaccccaacagugggugcuuccaaguuacucaggcagaaauacuccuaaugugcaucuggcccccgcuguagcccccacuuuuccgggugagcaacuucucuucuucagauccaccaugcccggaugcagcggguaccccaacauggacuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5086 - RNA, 1623 nt, Artificial Sequence
  VP1__Norovirus__AGS08054
augaagauggcgucgagugacgccaacccaucugauggguccacagccaaccucgucccagaggucaauaaugagguuauggcuuuggagcccguaguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugauuugaaucccuaccuuucccauuuggccagaauguacaaugguuacgcaggugguuuugaagugcagguaauccucgcggggaacgcguucaccgccgggaaaaucauauuugcagcagucccaccaaauuucccaacugaagguuugagccccagccaagucacuauguucccccacauaauaguagauguuaggcaauuggaaccuguacugauccccuuacccgauguuaggaauaauuucuaccauuauaaccagucaaaugaccccaccaucaaauugauagcaauguuguauacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacucaacuaucuccugucaacaucuguaccuucagaggggaugucacccacauuucaggcagucguaacuacacaaugaauuuggccucccaaaauuggaacaguuacgauccaacagaagaaaucccagccccccuaggaacuccagauuucguggggaagauccaaggugugcucacccaaaccacaagaacagauggcucgacccgcggccacaaagcuacaguguacacugggagcgccgacuuuucuccaaaacuggguaggguucaauucgccacugacacagacaaugauuuuguagcugaccaaaacacaaaguucaccccagucgguguuauccaggaugguagcacuaccccccgaaaugaaccccaacaaugggugcucccaaguuacucaggcagaaacacucauaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguuaagguuugugaauccagacacagguaggguuuuguuugagugcaagcuucauaaaucaggcuauguuacaguggcucacacuggccaacaugauuuaguuaucccccccaauggcuauuuuagauuugauuccugggucaaccaguucuacacacuugcccccaugggaaaugggacggggcguagacgugcauuauaa

SEQ ID NO: 5087 - RNA, 1623 nt, Artificial Sequence
  VP1__Norovirus__AGS08056
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaccuaaaucccuaccuaucccauuuggccagaauguacaaugguuaugcaggugguuuugaagugcagguaauucucgcggggaacgcguucaccgcugggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuaugucacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5088 - RNA, 1623 nt, Artificial Sequence
  VP1__Norovirus__AGS08057
augaagauggcgucgagugacgcccacccaucugauggguccacagccaaccucgucccagaggucaacaaugagguuauggcuuuggagcccguaguuggugccgcuauugcggcaccuguggcgggccagcaaaauguaauugaccccuggauuagaaacaauuuuguucaagccccugguggagaguucacaguauccccuagaaacgcuccaggugaaauacuauggagcgcgcccuuaggcccugacuugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaucauuauaaucagucaaaugaccccaccaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccaucccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgacccaacagaagagaucccagccccccugggaacuccagauuucguggggaagauucaaggugugcucacccaaaccacaagggcagauggcucgacccgcggccacaaagcuacaguguacacugggagcgccgacuuuucuccaaaacuggguaggguucaauuugccacugacacagacaaugauuuuguagcuaaccaaaacacaaaguucaccccagucgguguuauccaggaugguaguacuaccccccgaaaugaaccccaacaaugggugcuuccaaguuacucaggcagaaacacucauaaugugcaccuggcccccgcuguggcccccacguucccgggcgagcaacuccucuucuucagaucuaccaugcccggaugcagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacgugcauuauaa

SEQ ID NO: 5089 - RNA, 1623 nt, Artificial Sequence
  VP1__Norovirus__AGS08058
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacaagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaauuccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccagucggugucauccaagaugguggcaccacccaccgaaaugaaccccaacagugggugcucccaaguuacucaggcagaaacacucauaaugugcaucuggcucccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcccacacuggccaacaugauuugguuaucccccccaaugguuauuuuagguuugauuccugggucaaccaguuuuacacgcuugcccccaugggaaauggaacggggcguagacgugcaguauaa

SEQ ID NO: 5090 - RNA, 1623 nt, Artificial Sequence
  VP1__Norovirus__AGS08059
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggaacgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaauugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuugugggaaagauucaaggcgugcuuacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccagucggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacuguuugcucccccaggaaugggugcaguacuucuaccaagaggcagcuccagcacaaucugauguggcucugcuaagauuugugaauccagacacagguaggguuuuguuugaguguaagcuucauaaaucaggcuaugcuacaguggcucacacuggccaacaugauuugguuaucccccccaaugguuauuuuagguuugauuccugggucaaccaguuuuacacgcuugcccccaugggaaauggaacggggcguagacgugcaguauaa

SEQ ID NO: 5091 - RNA, 1623 nt, Artificial Sequence
  VP1__Norovirus__AGS08060
augaagauggcgucgagugacgccaacccaucugauggguccgcagccaaccucgucccagaggucaacaaugagguuauggcucuggagcccguuguuggugccgccauugcggcaccuguagcgggccagcaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaccaaucaaaugaccccaccauuaaguugauagcaauguuguauacaccacuuagggcuaauaaugcuggggaugaugucuuuacaguuucuugccgaguucucacgagaccaucccccgauuuugauuucauauuucuagugccacccacaguugagucaagaaccaaaccauucucugucccaguuuuaacuguugaggagaugaccaauucaagauuccccauuccuuuggaaaaguuguucacgggucccaguagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacguggccacaaagcuacaguguacacugggagcgccgauuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggccccugcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5092 - RNA, 1623 nt, Artificial Sequence
  VP1__Norovirus__AGS08061
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcaggugauccucgcggggaacgcguucaccgccgggaaaaucauauuugcagcagucccaccaaauuucccaacugaagguuugagccccagccaagucacuauguucccccacauaauaguagauguuaggcaauuggaaccuguguugauucccuuacccgauguuaggaauaauuucuaccauuauaaucaaucaaaugacuccaccaucaaauugauagcaauguuguacacaccacuuagggcuaauaaugcuggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaacucaagguuccccauuccuuuggaaaaauuguucacgggccccaguagugccuuuguuguucaaccacaaaacggcaggugcacgacugauggcgugcuccuagguacuacccaacugucuccugucaacaucugcaccuucagaggagaugucacccauauuccaggcagucguaacuacacaaugaauuuggccucccaaaauuggaacaguuacgauccaacagaagaaaucccagccccucuaggaacuccagauuucguggggaagauucaaggugugcucacccagaccacaaggacaaauggcucgacccguggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauucauaaugugcaccuggcccccgcuguagcccccacuuucccgggcgagcagcuucucuucuucaggucuacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 5093 - RNA, 1623 nt, Artificial Sequence
  VP1__Norovirus__AGS08062
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaacucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaauuccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguggcaccacccaccgaaaugaaccccaacagugggugcuuccaaguuacucaggcagaaauacuccuaaugugcaucuggcccccgcuguagcccccacuuuuccgggugagcaacuucucuucuucagauccaccaugcccggaugcagcggguaccccaacauggacuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5094 - RNA, 1623 nt, Artificial Sequence
  VP1__Norovirus__AGS08063
augaagauggcgucgagugacgccaacccaucugauggguccacagccaaccucgucccagaggucaacaaugagguuauggcuuuggagcccgugguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugacuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagaugucaggcaauuggaaccuguguugauccccuuacccgauguuaggaauaauuucuaccauuauaaucaaucaaaugauuccaccaucaaauugauagcaauguuguacacaccacuuagggcuaauaaugccggggaugaugucuucacaguuucuugucgaguucuuacgagaccaucccccgauuuugauuuuauauuuuuggugccacccacaguugaaucaagaacuaaaccauucucugucccaauuuuaacuguugaggagaugaccaauucaagguuccccauuccuuuggaaaaguuguucacgggccccaguagugccuuuguuguucaaccacaaaacggcaggugcacgacugauggcgugcuccuagguaccacucaacuaucuccugucaacaucugcaccuucagaggggacgucacccauauuccaggcagucauaacuacacaaugaauuuggccucccaaaauuggaacaguuacgauccaacagaagaaaucccagccccucuaggaacuccagauuucguggggaagauucaaggugugcucacucaaaccacuaguacaaauggcucgacccgcggccacaaagcuacaguguacacugggagcgccgacuuuucuccaaaacugggcagaguucaguuugccacugacacaaacaaugauuuugaaacuaaccaaaacacaaaauucaccccagucggcguuauccaggaugguaguacuaccccccgaaaugaaccccaacaaugggugcucccaaguuacucaggcagaaacauucacaaugugcaccuggcccccgcuguggcccccacuuucccgggcgaacagcuccucuucuucagaucuacuaugcccggaugcagcggguaccccaacauggauuuggauugucugcucccccaggaaugggugcaguacuucuaccaggaggcagccccagcacaaucugauguggcccuguuaagauuugugaauccagacacagguaggguuuuguuugaguguaagcuucauaaaucaggcuauguuacaguggcucauacuggccagcaugauuugguuaucccccccaaugguuauuuuagauuugacuccugggucaaccaguucuacacacuugcccccaugggaaaugggacggggcguagacgugcauuauaa

SEQ ID NO: 5095 - RNA, 1623 nt, Artificial Sequence
  VP1__Norovirus__AGS08064
augaagauggcgucgagugacgccaacccaucugauggguccacagccaaccucgucccagaggucaacaaugagguuauggcuuuggagcccguaguuggugccgccauugcggcaccuguagcgggccagcaaaauguaauugaccccuggauuagaaacaauuuuguacaagccccugguggagaguuuacaguauccccuagaaacgcuccaggugaaauacuauggagugcgcccuuaggccccgauuugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaacuggaaccuguguugauccccuuacccgauguuaggaauaauuucuaccacuauaaucagucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgauccaacagaagaaaucccagccccccuaggaacuccagauuucguggggaagauucaaggugugcucacccaaaccacaaggacagauggcucgacccgcggccacaaagcuacaguauacacugggagcgccgacuuuucuccaaaacuggguaggguucaauuugccacugacacagacaaugauuuuguaacuaaccaaaacacaaaguucaccccagucgguguuauccaggaugguaguacuaccccccgaaaugaaccccaacaaugggugcucccaaguuacucaggcagaaacacucauaaugugcaccuggcccccgcuguagcccccacuuucccgggcgagcagcuccucuucuucagaucuaccaugcccgggugcagcggguaccccaacauggauuuggacugucugcucccccaggaaugggugcaguauuucuaccaggaagcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacgugcauuauaa

SEQ ID NO: 5096 - RNA, 1623 nt, Artificial Sequence
  VP1__Norovirus__AGS08065
augaagauggcgucgagugacgccaacccaucugauggguccacagccaaucucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguguccccuagaaacgcuccaggugaaauacuauggagcgcgcccuuaggcccugauuugaaucccuaccuuucccauuuggccagaauguacaaugguuaugcagguggcuuugaagugcagguaauccucgcggggaacgcguucaccgccgggaaaaucauauuugcagcagucccaccaaauuuuccaacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaauggcaggugcacgacugauggcgugcuccuagguacuacccaacuguccccugucaacaucugcaccuucagaggggaugucacccauauuccaggcagucguaacuacacaaugaauuuggccucccaaaauuggaacaguuacgauccaacagaagaaaucccagccccucuaggaaccccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucauaaugugcaccuggcccccgcuguagcccccacuuucccgggcgagcagcuccucuucuucagauccacuaugcccggaugcagcggguaccccaacauggauuuggacugucugcucccccaggaaugggugcaguauuucuaccaagaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 5097 - RNA, 1623 nt, Artificial Sequence
  VP1__Norovirus__AGS08066
augaagauggcgucgagugacgccaacccaucugauggguccacagccaaccucgucccagaggucaacaaugagguuauggcuuuggagcccgugguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguauaaugguuaugcaggugguuuugaagugcagguaauccucgcggggaacgcguucaccgccgggaaaaucauauuugcagcaguuccaccaaauuuuccaacugaagguuugagccccagccaggucacuauguucccccacauaauaguagauguuaggcaauuggaaccuguguugauccccuuacccgauguuaggaauaauuucuaccauuauaaucaaucaaaugauuccaccaucaaauuaauagcaauguuguacacaccacuuagggcuaauaaugccggggaugaugucuucacaguuucuugucgaguucucacgagaccaucccccgauuuugauuuuauauuuuuggugccacccacaguugaaucaagaacuaaaccauucucuguuccaauuuuaacuguugaggagaugaccaauucaagguuccccauuccuuuggaaaaguuguucacgggccccaguagugccuuuguuguucaaccacaaaacggcaggugcacgacugauggcgugcuccuagguaccacucaacugucuccugucaacaucugcaccuucagaggggaugucacccauauuccaggcagucauaacuacacaaugaauuuggccucccaaaauuggaacaguuacgauccaacagaagaaaucccagccccucuaggaacuccagauuucguggggaagauucaaggugugcucacucaaaccacuaguacaaauggcucgacccgcggccacaaagcuacaguguacacugggagcgccgacuuuucuccaaaacuggguagaguucaauuugccacugacacaaacaaugauuuugaaacuaaccaaaacacaaaauucaccccagucggcguuauccaggaugguagcaccaccccccgaaaugaaccccaacaaugggugcucccaaguuacucagguagaaacauucacaaugugcaccuggcccccgcuguagcccccacuuucccgggcgagcagcuccucuucuucagaucuacuaugcccggaugcagcggguaccccaacauggacuuggauugucugcucccccaggaaugggugcaguauuucuaccaggaggcagccccagcacaaucugauguggcucuguugagauuugugaauccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacgugcauuauaa

SEQ ID NO: 5098 - RNA, 1623 nt, Artificial Sequence
  VP1__Norovirus__AGS08067
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguucaggccccugguggagaguucacaguauccccuagaaacgcuccaggugaaauacuauggagcgcgcccuuaggcccugacuugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggagccuguguugauccccuuacccgauguuaggaauaauuucuaucauuauaaucagucaaaugaccccacuaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccaucccuuuggaaaaguuauucacgggccccaguagugccuuuguuguucaaccacaaaacggcagguguacgacugauggcgugcuccuagguacuacccaacugucuccugucaacaucugcaccuucagaggggaugucacccacauuucaggcagucguaacuacacaaugaauuuggccucccaaaauuggaacaguuacgacccaacagaagaaaucccagccccccugggaacuccagauuucguggggaagauucaaggcgugcucacccaaaccacaaggacagauggcucgacccgcggccacaaagcuacaguguacacugggagcgccgacuuuucuccaaaacuggguaggguucaauuugccacugacacagacaaugauuuuguaacuaaccaaaacacaaaguucaccccagucgguguuauccaggaugguagcacuaccccccgaaaugaaccccaacaaugggugcuuccaaguuacucaggcagaaacacucauaaugugcaucuggcccccgcuguggcccccacauucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacgugcauuguaa

SEQ ID NO: 5099 - RNA, 1623 nt, Artificial Sequence
  VP1__Norovirus__AGS08068
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguucaagccccugguggagaguucacaguauccccuagaaaugcuccaggugaaauacuauggagcgcgcccuuaggcccugacuugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaucauuauaaucagucaagugaccccaccaucaaauugauagcaauguuguauacaccacuuagggcuaacaaugccggggacgaugucuucacaguuucuugucgaguucucacgagaccaucccccgauuuugauuucauauuuuuagugccacccacaguugaaucaagaacuaaaccauucucugucccaguuuuaacuguugaggagaugaccaauucaagguuccccaucccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgacccaacagaagagaucccagccccccugggaacuccagauuucguggggaagauucaaggcgugcucacccaaaccacaaggacagauggcucgacccgcggccacaaagcuacaguguacacugggagcgccgacuuuucuccaaaacuggguaggguucaauuugccacugacacagacaaugauuuuguaacuaaccaaaacacaaaguucaccccagucgguguuauucaggaugguaguacuaccccccgaaaugaaccccaacaaugggugcuuccaaguuacucaggcagaaacacucauaaugugcaccuggcccccgcuguggcccccacguucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacgugcauuauaa

SEQ ID NO: 5100 - RNA, 1623 nt, Artificial Sequence
  VP1__Norovirus__AGS08069
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcaggugauccucgcggggaacgcguucaccgccgggaaaaucauauuugcagcagucccaccaaauuucccaacugaagguuugagccccagccaagucacuauguucccccacauaauaguagauguuaggcaauuggaaccuguguugauucccuuacccgauguuaggaauaauuucuaccauuauaaucaaucaaaugacuccaccaucaaauugauagcaauguuguacacaccacuuagggcuaauaaugcuggggacgaugucuucacaguuucuugucgaguucucacgagaccaucccccgauuuugauuucauauuucuggugccacccacaguugaaucaagaacuaaaccauucucugucccaguuuuaacuguugaggagaugaccaacucaagguuccccauuccuuuggaaaaauuguucacgggccccaguagugccuuuguuguucaaccacaaaacggcaggugcacgacugauggcgugcuccuagguacuacccaacugucuccugucaacaucugcaccuucagaggagaugucacccauauuccaggcagucguaacuacacaaugaauuuggccucccaaaauuggaacaguuacgauccaacagaagaaaucccagccccucuaggaacuccagauuucguggggaagauucaaggugugcucacccagaccacaaggacaaauggcucgacccguggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacacucauaaugugcaccuggcccccgcuguagcccccacuuuuccgggcgagcagcuucucuucuucaggucuacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 5101 - RNA, 1623 nt, Artificial Sequence
  VP1__Norovirus__AGS08070
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuuggagugcagguaauucucgcggggaacgcguucaccgccgggaaggucauauuugcagcagucccaccaaauuuuccaacugaaggcuugagccccagccaggucacuauguucccccauauaguaguaaauguuaggcaacuagaaccuguguugauucccuuacccgauguuaggaauaauuucuaucauuauaaucaaucaaaugaccccaccauuaaauugauagcuauguuguacacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccgacagaagaaaccccagccccucuaggaacuccagacuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccagucggugucauccaagaugguaguaccacccaucgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucuuacuggccaacaugauuugguuauuccccccaaugguuauuuuagauuugacuccugggucaaccaguucuacacgcuugcccccaugggaaauggaacggggcguagacgugcaguauaa

SEQ ID NO: 5102 - RNA, 1623 nt, Artificial Sequence
  VP1__Norovirus__AGS08071
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5103 - RNA, 1623 nt, Artificial Sequence
  VP1__Norovirus__AGS08072
augaagauggcgucgagugacgccaacccaucugauggguccacagccaaccucgucccagaggucaacaaugagguuauggcuuuggagcccguaguuggugccgccauugcggcgccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccgacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguacacaccacuuagggcuaauaaugccggggacgaugucuucacgguuucuugucgaguucucacgagaccaucccccgauuuugauuucauauuuuuggugccacccacaguugaaucaagaacuaaaccauucucuguuccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaaaauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccagcaugacuugguuaucccccccaaugguuauuuuagauuugauuccugggucaaccaguucuacacacuugcccccaugggaaaugggacggggcguagacgugcauuauaa

SEQ ID NO: 5104 - RNA, 1623 nt, Artificial Sequence
  VP1__Norovirus__AGS08073
augaagauggcgucgagugacgccaauccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuaucccauuuggccagaauguacaaugguuaugcaggugguuuugaagugcagguaauccucgcggggaacgcguucaccgccgggaaaaucauauuugcagcagucccgccaaauuucccaacugaagguuugagccccagccaagucacuauguucccccacauaauaguagauguuaggcaauuggaaccuguguugauccccuuacccgauguuaggaauaauuucuaccauuauaaucaaucaaaugauuccaccaucaaauugauagcaauguuguacacaccacuuagggcuaauaaugccggggaugaugucuuuacaguuucuugucgaguucucacgagaccaucccccgauuuugauuucauauuuuuggugccacccacaguugaaucaagaacuaaaccauucucugucccaguuuuaacuguugaggagaugaccaacucaagguuccccauuccuuuggaaaaauuguucacgggccccaguagugccuuuguuguucaaccacaaaacggcaggugcacgacugauggcgugcuccuagguacuacccaacugucuccugucaacaucugcaccuucagaggggaugucacccauauuucaggcagucguaacuacacaaugaauuuggccucccaaaauuggaacaguuacgauccaacagaagaaaucccagccccucuaggaacuccagauuucguggggaaaauucaaggugugcucacccaaaccacaaggacaaauggcucgacccgcggccacaaagcuacaguguacacugggagcgccgacuuuucuccaaaacuggguagaguucaauucgccacugacacagacaaugauuuugaaacuaaccaaaacacaaaguucaccccagucgguguuauccaggaugguaguacuaccccccgaaaugaaccccaacaaugggugcucccaaguuacucaggcagaaacauucauaaugugcaccuggcccccgcuguggcccccacuuucccgggcgagcagcuucucuucuucagaucuacuaugcccggaugcagcggguaccccaacauggacuuggacugucugcucccccaggaaugggugcaguacuucuaucaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 5105 - RNA, 1623 nt, Artificial Sequence
  VP1__Norovirus__AGS08074
augaagauggcgucgagugacgccaacccaucugauggguccacagccaaccucgucccagaggucaacaaugagguuauggcuuuggagcccgugguuggugccgccauugcggcaccuguagcgggccaacaaaauguaauugaccccuggauuagaaacaauuuuguacaagccccugguggagaguuuacaguauccccuagaaacgcuccaggugaaauacuauggagugcgcccuuaggcccugacuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagaugucaggcaauuggaaccuguguugauccccuuacccgauguuaggaauaauuucuaccauuauaaucaaucaaaugauuccaccaucaaauugauagcaauguuguacacaccacuuagggcuaauaaugccggggaugaugucuucacaguuucuugucgaguucuuacgagaccaucccccgauuuugauuuuauauuuuuggugccacccacaguugaaucaagaacuaaaccauucucugucccaauuuuaacuguugaggagaugaccaauucaagguuccccauuccuuuggaaaaguuguucacgggccccaguagugccuuuguuguucaaccacaaaacggcaggugcacgacugauggcgugcuccuagguaccacucaacuaucuccugucaacaucugcaccuucagaggggacgucacccauauuccaggcagucauaacuacacaaugaauuuggccucccaaaauuggaacaguuacgauccaacagaagaaaucccagccccucuaggaacuccagauuucguggggaagauucaaggugugcucacucaaaccacuaguacaaauggcucgacccgcggccacaaagcuacaguguacacugggagcgccgacuuuucuccaaaacugggcagaguucaguuugccacugacacaaacaaugauuuugaaacuaaccaaaacacaaaauucaccccagucggcguuauccaggaugguaguacuaccccccgaaaugaaccccaacaaugggugcucccaaguuacucaggcagaaacauucacaaugugcaccuggcccccgcuguggcccccacuuucccgggcgaacagcuccucuucuucagaucuacuaugcccggaugcagcggguaccccaacauggauuuggauugucugcucccccaggaaugggugcaguacuucuaccaggaggcagccccagcacaaucugauguggcccuguuaagauuugugaauccagacacagguaggguuuuguuugaguguaagcuucauaaaucaggcuauguuacaguggcucauacuggccagcaugauuugguuaucccccccaaugguuauuuuagauuugacuccugggucaaccaguucuacacacuugcccccaugggaaaugggacggggcguagacgugcauuauaa

SEQ ID NO: 5106 - RNA, 1623 nt, Artificial Sequence
  VP1__Norovirus__AGS08076
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacuauggagcgcgcccuuaggcccugaucugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaagguuugagccccagccaagucacuauguucccccacauaauaguagauguuaggcaauuggaaccuguguugauccccuuacccgauguuagaaauaauuucuaccauuauaaucagucaaaugaccccaccaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggaaaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuaugauccaacagaagaaauuccagccccccuaggaacuccagauuucguggggaagauucaagguguacucacccaaaccacaaggacagauggcucgacccgcggccacaaagcuacaguguacacugggagcgccgacuuuucuccaaaacuggguaggguucaauuugccacugacacagacaaugauuuuguaacuaaccaaaacacaaaguucaccccagucgguguuauccaggaugguaguacuaccccccgaaaugaaccccaacaaugggugcucccaagcuacucaggcagaaacacucauaaugugcaccuggcccccgcuguagcccccacuuucccgggcgagcagcuccucuucuuuagauccaccaugcccggaugcagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacgugcauuauaa

SEQ ID NO: 5107 - RNA, 1623 nt, Artificial Sequence
  VP1__Norovirus__AGS08079
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacuauggagcgcgcccuuaggcccugaucugaaucccuaccuuucccauuuggccagaauguacaaugguuaugcaggugguuuugaagugcagguaauccucgcggggaaugcguucaccgccggaaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucagucaaaugaccccaccaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuaugauccaacagaagaaaucccagccccccuaggaacuccagauuucguggggaagauucaaggugugcucacccaaaccacaaggacagauggcucgacccgcggccacaaagcuacaguguacacugggagcgccgacuuuucuccaaaacuggguaggguucaauuugccacugacacagacaaugauuuuguaacuaaccaaaacacaaaguucaccccagucgguguuauccaggaugguaguacuaccccccgaaaugaaccccaacaaugggugcucccaaguuacucaggcagaaacacucauaaugugcaccuggcccccgcuguagcccccacuuucccgggcgagcagcuccucuucuucagaucuaccaugcccggaugcagcggguaccccaacauggauuuggacugucugcucccccaggaaugggugcaauauuucuaccaggaggcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacgugcauuauaa

SEQ ID NO: 5108 - RNA, 1623 nt, Artificial Sequence; identical to SEQ ID NO: 5094
  VP1__Norovirus__AGS08080

SEQ ID NO: 5109 - RNA, 1623 nt, Artificial Sequence
  VP1__Norovirus__AGS08081
augaagauggcgucgagugacgccaacccaucugauggguccacagccaaccucgucccagaggucaacaaugagguuauggcuuuggagcccgugguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuuuccaacugaagguuugagccccagccaggucacuauguucccccacauaauaguagauguuaggcaauuggaaccuguguugauccccuuacccgauguuaggaauaauuucuaucauuauaaucaaucaaaugauuccaccaucaaauugauagcaauguuguacacaccacuuagggcuaauaaugccggggaugaugucuucacaguuucuugucgaguucucacgagaccaucccccgauuuugauuuuauauuuuuggugccacccacaguugaaucaagaacuaaaccauucucugucccaauuuuaacuguugaggagaugaccaauucaagguuccccauuccuuuggaaaaguuguucacgggccccaguagugccuuuguuguucaaccacaaaacggcaggugcacgacugauggcgugcuccuagguaccacucagcugucuccugucaacaucugcaccuucagaggggaugucacccauauuccaggcagucauaacuacacaaugaauuuggccucccaaaauuggaacaguuacgauccaacagaagaaaucccagccccucuaggaacuccagauuucguggggaagauucaaggugugcucacucaaaccacuaguacaaauggcucgacccgcggccacaaagcuacaguguacacugggagcgccgacuuuucuccaaaacuggguagaguucaauuugucacugacacaaacaaugauuuugaaacuaaccaaaacacaaaauucaccccagucggcguuauccaggaugguagcaccaccccccgaaaugaaccccaacaaugggugcucccaaguuacucagguagaaacauucacaaugugcaccuggcccccgcuguagcccccacuuucccgggcgagcagcuccucuucuucagaucuacuaugcccggaugcagcggguaccccaacauggacuuggauugucugcucccccaggaaugggugcaguauuucuaccaggaggcagccccagcacaaucugauguggcucuguugagauuugugaauccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacgugcauuauaa

SEQ ID NO: 5110 - RNA, 1623 nt, Artificial Sequence
  VP1__Norovirus__AGS08082
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguucaagccccugguggagaguucacaguauccccuagaaacgcuccaggugaaauacuauggagcgcgcccuuaggcccugacuugaaucccuaccuuucccauuuggccagaauguacaaugguuaugcagguggcuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaucauuauaaucagucaaaugaccccaccaucaaauugauagcaauguuguacacaccacuuagggcuaacaaugccggggacgauguuuucacaguuucuugucgaguucucacgagaccaucccccgauuuugauuucauauuuuuggugccacccacaguugaaucaagaacuaaaccauucucugucccaguuuuaacuguugaggagaugacuaauucaagguuccccaucccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgacccaacagaagagaucccagccccccugggaacuccagauuucguggggaagauucaaggcgugcucacccaaaccacaaggacagauggcucgacccgcggccacaaagcuacaguguacacugggagcgccgacuuuacuccaaaacuggguaggguucaauuugccacugacacagacaaugauuuuguaacuaaccaaaacacaaaguucaccccagucgguguuauccaggaugguaguacuaccccccgaaaugaaccccaacaaugggugcuuccaaguuacucaggcagaaacacucauaaugugcaccuggcccccgcuguggcccccacguucccgggcgagcagcuccucuucuucagaucuaccaugcccggaugcagcggguaccccaacauggauuuggacugucugcucccccaggaaugggugcaguauuucuaccaggaggcagccccagcacaaucugauguggcgcuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacgugcauuauaa

SEQ ID NO: 5111 - RNA, 1623 nt, Artificial Sequence; identical to SEQ ID NO: 5027
  VP1__Norovirus__AGS08083

SEQ ID NO: 5112 - RNA, 1623 nt, Artificial Sequence
  VP1__Norovirus__AGS08084
augaagauggcgucgagugacgccaacccaucugauggguccacagccaaccucgucccagaggucaacaaugagguuauggcuuuggagcccguaguuggugccgccauugcggcaccuguggcgggccaacaaaauguaauugaccccuggauuagaaacaauuuuguacaagccccugguggagaguuuacaguauccccuagaaacgcuccaggugaaauacuauggagcgcgcccuuagguccugacuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuagacaauuggaaccuguguugaucccuuugcccgauguuaggaauaauuucuaccauuauaaucaaucauaugaccccaccaucaaauugauagcaauguuguacacaccacuuagggcuaauaaugccggggacgaugucuucacaguuucuugucgaguucuuacgagaccaucccccgauuuugauuucauauuuuuggugccacccacaguugaaucaagaacuaaaccauucucugucccaguuuuaacugucgaggagaugaccaauucaagguuucccauuccuuuggaaaaguuguucacgggccccaguagugcuuuuguuguucaaccacaaaacggcaggugcacgacugauggcgugcuccuagguacuacccaacugucuccugucaacaucugcaccuucagaggggaugucacccauauuccaggcagucauaacuacacaaugaauuuggccucccaaaauuggaacaguuacgauccaacagaagaaaucccagccccucuaggaacuccagauuucguggggaagauucaaggugugcucacccaaaccacaaagacaaauggcucgacccgcggccacaaagccacaguguacacugggagcgccgacuuuucuccaaagcuggguaggguucaauuugccacugacacaaacaaugauuuugaaacuaaccaaaacacaaaguucaccccagucgguguuauccaggaugguaguacuacuccccgaaaugaaccccaacaaugggugcucccaaguuacucgggcagaaacauucacaaugugcaccuggcccccgcuguagcccccacuuucccgggcgagcagcuccucuucuucagaucuacuaugcccggaugcagcggguaccccaacauggauuuggacugucugcucccccaggagugggugcaguacuucuaccaggaggcagccccagcacaaucugauguggcucuguuaagauuugugaauccagacacagguaggguuuuguuugaguguaagcuucauaaaucagguuauguuacaguggccuacacuggccaacaugauuugguuaucccccccaaugguuauuuuagauuugauuccugggucaaccaguucuacacacuugcccccaugggaaaugggacggggcguagacgugcauuauaa

SEQ ID NO: 5113 - RNA, 1623 nt, Artificial Sequence
  VP1__Norovirus__AGS08085
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguauugauucccuuacccgauguuaggaauaauuucuaucauuacaaucaaucaaaugaccccaccauuaaauugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuugugggaaagauucaaggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccagucggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacuguuugcucccccaggaaugggugcaguacuucuaccaagaggcagcuccagcacaaucugauguggcucugcuaagauuugugaauccagacacagguaggguuuuguuugaguguaagcuucauaaaucaggcuaugcuacaguggcucacacuggccaacaugauuugguuaucccccccaaugguuauuuuagguuugauuccugggucaaccaguuuuacacgcuugcccccaugggaaauggaacggggcguagacgugcaguauaa

SEQ ID NO: 5114 - RNA, 1623 nt, Artificial Sequence
  VP1__Norovirus__AGS08086
augaagauggcgucgagugacgccaacccaucugauggguccacagccaaccucgucccagaggucaacaaugagguuauggcuuuggagcccgugguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuuuccaacugaagguuugagccccagccaggucacuauguucccccacauaauaguagauguuaggcaauuggaaccuguguugauccccuuacccgauguuaggaauaauuucuaccauuauaaucaaucaaaugauuccaccaucaaauugauagcaauguuguacacaccacuuagggcuaauaaugccggggaugaugucuucacaguuucuugucgaguucucacgagaccaucccccgauuuugauuuuauauuuuuggugccacccacaguugaaucaagaacuaaaccauucucugucccaauuuuaacuguugaggagaugaccaauucaagguuccccauuccuuuggaaaaguuguucacgggccccaguagugccuuuguuguucaaccacaaaacggcaggugcacgacugauggcgugcuccuagguaccacucaacugucuccugucaacaucugcaccuucagaggggaugucacccauauuccaggcagucauaacuacacaaugaauuuggccucccaaaauuggaacaguuacgauccaacagaagaaaucccagccccucuaggaacuccagauuucguggggaagauucaaggugugcucacucaaaccacuaguacaaauggcucgacccgcggccacaaagcuacaguguacacugggagcgccgacuuuucuccaaaacuggguagaguucaauuugccacugacacaaacaaugauuuugaaacuaaccaaaacacaaaauucaccccagucggcguuauccaggaugguagcaccaccccccgaaaugaaccccaacaaugggugcucccaaguuacucagguagaaacauucacaaugugcaccuggcccccgcuguagcccccacuuucccgggcgagcagcuccucuucuucagaucuacuaugcccggaugcagcggguaccccaacauggacuuggauugucugcucccccaggaaugggugcaguauuucuaccaggaggcagccccagcacaaucugauguggcucuguugagauuugugaauccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacgugcauuauaa

SEQ ID NO: 5115 - RNA, 1623 nt, Artificial Sequence
  VP1__Norovirus__AGS08087
augaagauggcgucgagugacgccaacccaucugauggguccacagccaaccucgucccagaggucaacaaugagguuauggcuuuggagcccguaguuggugccgccauugcggcaccuguagcgggccagcaaaauguaauugaccccuggauuagaaacaauuuuguacaagccccugguggagaguuuacaguauccccuagaaacgcuccaagcacaauacuauggagugcgcccuuaggccccgauuugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccacuauaaucagucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgauccaacagaagaaaucccagccccccuaggaacuccagauuucguggggaagauucaaggugugcucacccaaaccacaaggacagauggcucgacccgcggccacaaagcuacaguauacacugggagcgccgacuuuucuccaaaacuggguaggguucaauuugccacugacacagacaaugauuuuguaacuaaccaaaacacaaaguucaccccagucgguguuauccaggaugguaguacuaccccccgaaaugaaccccaacaaugggugcucccaaguuacucaggcagaaacauucauaaugugcaccuggcccccgcuguagcccccacuuucccgggcgagcagcuccucuucuucagaucuaccaugcccgggugcagcggguaccccaacauggauuuggacugucugcucccccaggaaugggugcaguauuucuaccaggaagcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacgugcauuauaa

SEQ ID NO: 5116 - RNA, 1623 nt, Artificial Sequence; identical to SEQ ID NO: 5105
  VP1__Norovirus__AGS08088

SEQ ID NO: 5117 - RNA, 1623 nt, Artificial Sequence; identical to SEQ ID NO: 5092
  VP1__Norovirus__AGS08089

SEQ ID NO: 5118 - RNA, 1623 nt, Artificial Sequence
  VP1__Norovirus__AGS08090
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguucaagccccugguggagaguucacaguauccccuagaaacgcuccaggugaaauacuauggagcgcgcccuuaggcccugacuugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaucauuauaaucagucaaaugaccccacuaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccaucccuuuggaaaaguuauucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgacccaacagaagaaaucccagccccccugggaacuccagauuucguggggaagauucaaggcgugcucacccaaaccacaaggacagauggcucgacccgcggccacaaagcuacaguguacacugggagcgccgacuuuucuccaaaacuggguaggguucaauuugccacugacacagacaaugauuuuguaacuaaccaaaacacaaaguucaccccagucggugucauccaggaugguagcacuaccccccgaaaugaaccccaacaaugggugcuuccaaguuacucaggcagaaacacucauaaugugcaccuggcccccgcuguggcccccacguucccgggcgagcagcuccucuucuucagaucuaccaugcccggaugcagcggguaccccaacauggauuuggacugucugcucccccaggaaugggugcaguauuucuaccaggaggcagccccagcacaaucugauguggcgcuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacgugcauuauaa

SEQ ID NO: 5119 - RNA, 1623 nt, Artificial Sequence
  VP1__Norovirus__AGS08091
augaagauggcgucgagugacgccaacccaacugauggguccgcagccaaccucguaccagaggucaacaaugagguuauggcucuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaagaucauauuugcagcagucccaccaaauuuuccaaccgaaggcuuaagccccagccaggucacuauguucccccacauaauaguagauguuagacaauuagaaccugugcugauucccuuacccgaugucaggaauaauuucuaucauuacaaucaaucaaaugacuccacuauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccacaaaacggcaggugcacgacugauggcgugcuccuaggcaccacccaacugucuccugucaacaucugcaccuucagaggggaugucacccacaucacagguagucguaacuacacaaugaauuuggcuucucaaaauuggaacaauuaugacccaacagaagaaaccccagccccucuaggaacuccagauuuuguggggaagauucaaggcaugcucacccaaaccacaaggacagaugguucaacacgcggccacaaagcuacaguguacacugggagcgccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucaggcuauguuacaguggcucacacuggccaacaugauuugguuaucccccccaaugguuacuucagguuugauuccugggucaaccaguucuacacgcuugcccccaugggaaauggaacggggcguagacguguaguauaa

SEQ ID NO: 5120 - RNA, 1623 nt, Artificial Sequence; identical to SEQ ID NO: 5027
  VP1__Norovirus__AGS08092

SEQ ID NO: 5121 - RNA, 1623 nt, Artificial Sequence
  VP1__Norovirus__AGS08093
augaagauggcgucgagugacgccaacccaucugauggguccacagccaaccucgucccagaggucaacaaugagguuauggcuuuggagcccguggucggugccgccauugcggcaccuguagcgggccaacaaaauguaauugaccccuggauuagaaacaauuuuguacaagccccugguggagaguuuacaguauccccuagaaacgcuccaggugaaauacuauggagugcgcccuuaggcccugacuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaagguuugagccccagccaggucacuauguucccccacauaauaguagaugucaggcaauuggaaccuguguugauccccuuacccgauguuaggaauaauuucuaccauuauaaucaaucaaaugauuccaccaucaaauugauagcaauguuguacacaccacuuagggcuaauaaugccggggaugaugucuucacaguuucuugucgaguucuuacgagaccaucccccgauuuugauuuuauauuuuuggugccacccacaguugaaucaagaacuaaaccauucucugucccaauuuuaacuguugaggagaugaccaauucaagguuccccauuccuuuggaaaaguuguucacgggccccaguagugccuuuguuguucaaccacaaaacggcaggugcacgacugauggcgugcuccuagguaccacucaacuaucuccugucaacaucugcaccuucagaggggacgucacccauauuccaggcagucauaacuacacaaugaauuuggccucccaaaauuggaacaguuacgauccaacagaagaaaucccagccccucuaggaacuccagauuucguggggaagauucaaggugugcucacucaaaccacuaguacaaauggcucgacccgcggccacaaagcuacaguguacacugggagcgccgacuuuucuccaaaacugggcagaguucaguuugccacugacacaaacaaugauuuugaaacuaaccaaaacacaaaauucaccccagucggcguuauccaggaugguagcacuaccccccgaaaugaaccccaacaaugggugcucccaaguuacucaggcagaaacauucacaaugugcaccuggcccccgcuguggcccccacuuucccgggcgaacagcuccucuucuucagaucuacuaugcccggaugcagcggguaccccaacauggauuuggauugucugcucccccaggaaugggugcaguacuucuaccaggaggcagccccagcacaaucugauguggcccuguuaagauuugugaauccagacacagguaggguuuuguuugaguguaagcuucauaaaucaggcuauguuacaguggcucauacuggccagcaugauuugguuaucccccccaaugguuauuuuagauuugacuccugggucaaccaguucuacacacuugcccccaugggaaaugggacggggcguagacgugcauuauaa

SEQ ID NO: 5122 - RNA, 1623 nt, Artificial Sequence
  VP1__Norovirus__AGS08094
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauauuauggagcgcgcccuuaggcccugaucugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaauuggaaccuguguugauccccuuacccgauguuaggaauaauuucuaccauuauaaucaaucaaaugaccccaccaucaaauugauagcaauguuguacacaccacuuagggcuaauaaugcuggggaugaugucuucacaguuucuugccgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaagcuguucacgggccccaguagugccuuuguuguucaaccacaaaauggcaggugcacgacugauggcgugcuccuagguacuacccaacuguccccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucauaaugugcaccuagcccccgccguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaaacuucauaaaucaggcuauguuacaguggcucacacuggccaacaugauuugguuaucccccccaaugguuacuuuagauuugauuccugggucaaccaguucuacacacuugcccccaugggaaaugggacggggcguagacgugcauuauaa

SEQ ID NO: 5123 - RNA, 1623 nt, Artificial Sequence
  VP1__Norovirus__AGS08095
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcagguggcuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaauggcaggugcacgacugauggcgugcuccuagguacuacccaacuguccccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucauaaugugcaccuggcccccgcuguagcccccacuuucccgggcgagcagcuccucuucuucagauccacuaugcccggaugcagcggguaccccaacauggauuuggacugucugcucccccaggaaugggugcaguauuucuaccaagaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 5124 - RNA, 1623 nt, Artificial Sequence
  VP1__Norovirus__AGS08096
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggccccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5125 - RNA, 1623 nt, Artificial Sequence
  VP1__Norovirus__AGS08097
augaagauggcgucgagugacgccaacccaucugauggguccacagccaaccucgucccagaggucaacaaugagguuauggcuuuggagcccguaguuggugccgcuauugcggcaccuguagcgggccagcaaaauauaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuacgcaggugguuuugaagugcagguaauccucgcggggaaugcguucaccgccgggaaaaucauauuugcagcagucccaccaaauuucccaacugaagguuugagccccagccaaguuacuauguucccccacauaauaguagauguuaggcaauuggaaccuguguugauccccuuacccgauguuaggaauaauuucuaccauuauaaucagucaaaugacuccaccaucaaauugauagcaauguuguacacaccacuuagggcuaacaaugccggggacgaugucuucacaguuucuugucgaguucucacgagaccaucccccgauuuugauuucauauuuuuggugccacccacaguugagucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgauccaacagaagaaaucccagccccccuaggaacuccagauuucguggggaagauucaaggugugcucacccaaaccacaaggacagauggcucgacccgcggccacaaagcuacaguguacacugggagcgccgacuuuucuccaaagcuggguaggguucaauuugccacugacacagacaaugauuuuguaacuaaucaaaacacaaaguucaccccagucgguguuauccaggaugguaguaccaccccccgaaaugaaccccaacaaugggugcucccaaguuacucaggcagaaacacucauaaugugcaccuggcccccgcuguagcccccacuuucccgggcgagcagcuccucuucuucagaucuaccaugcccggauguagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacgugcauuauaa

SEQ ID NO: 5126 - RNA, 1623 nt, Artificial Sequence
  VP1__Norovirus__AGS08098
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguucacaguauccccuagaaacgcuccaggugaaauacuauggagcgcgcccuuaggcccugaucugaaucccuaccuuucccauuuggccagaauguacaaugguuaugcaggugguuuugaagugcagguaauccucgcggggaaugcguucaccgccggaaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucagucaaaugaccccaccaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcucuuagguacuacccaacugucuccugucaacaucugcaccuucagaggggaugucacccacauuucaggcagucauaacuacacaaugaauuuggccucccaaaauuggaacaguuaugauccaacagaagaaaucccagccccccuaggaacuccagauuucguggggaagauucaaggugugcucacccaaaccacaaggacagauggcucgacccgcggccacaaagcuacaguguacacugggagcgccgacuuuucuccaaaacuggguaggguucaauuugccacugacacagacaaugauuuuguaacuaaccaaaacacaaaguucaccccagucgguguuauccaggaugguaguacuaccccccgaaaugaaccccaacaaugggugcucccaaguuacucaggcagaaacacucauaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaucaggcuaugucacaguggcucacacuggccaacaugauuuaguuaucccccccaaugguuauuuuagauuugauuccugggucaaccaguucuacacacuugcccccaugggaaacgggacggggcguagacgugcauuauaa

SEQ ID NO: 5127 - RNA, 1623 nt, Artificial Sequence; identical to SEQ ID NO: 5082
  VP1__Norovirus__AGS08099

SEQ ID NO: 5128 - RNA, 1623 nt, Artificial Sequence
  VP1__Norovirus__AGS08100
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcagguggcuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguacacaccacuuagggcuaauaaugccggggaugaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaauggcaggugcacgaccgauggcgugcuccuagguacuacccaacuguccccugucaacaucugcacuuucagaggggaugucacccauauuucaggcagucguaacuacacaaugaauuuggucucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucggugucauccaggaugguaguaccaccccccgaaaugaaccccaacaaugggugcucccaaguuacucaggcagaaacauucauaaugugcaccuggcccccgcuguagcccccacuuucccgggcgagcagcuccucuucuucagauccacuaugcccgggugcagcggguaccccaacauggauuuggacugucugcucccccaggaaugggugcaguauuucuaccaagaggcagccccagcacaaucugauguggcccuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaauucuacacacuugcccccaugggaaaugggacggggcguagacgugcauuauaa

SEQ ID NO: 5129 - RNA, 1623 nt, Artificial Sequence
  VP1__Norovirus__AGS08101
augaagauggcgucgagugacgccaacccaucugauggguccgcagccaaccucgucccagaggucaacaaugagguuauggcuuuggagcccguaguuggugccgcuauugcggcaccuguagcgggccaacaaaacgugauugaccccuggauuagaaacaauuuuguacaagccccugguggagaguuuacaguauccccuagaaacgcuccaggugaaauacuauggagcgcgcccuugggcccugauuugaaucccuaccuaucccauuuggccagaauguacaaugguuaugcaggugguuuugaagugcagguaauccucgcggggaaugcguucaccgcugggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucagucaaaugacuccaccaucaaauugauagcaauguuguacacaccacuuagggcuaauaaugcuggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucuguaccuucagaggggaugucacccacauuucaggcagucguaacuacacaaugaauuuggccucccaaaauuggaacaguuacgauccaacagaagaaaucccagccccccuaggaacuccagacuucguggggaagauucaaggugugcucacccaaaccacaagaacagauggcucgacccgcggccacaaagcuacaguguacacugggagcgccgacuuuucuccaaaacuggguaggguucaauuugccacugacacagacaaugauuuuauaacuaaccaaaacacaaaguucaccccagucgguguuauccaggaugguagcacuaccccccgaaaugaaccccaacaaugggugcucccaaguuacucaggcagaaacacucauaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguugagauuugugaauccagacacagguaggguuuuguuugaguguaagcuucauaaaccaggcuauguuacaguggcccacacuggccaacaugauuuaguuaucccccccaauggcuauuuuagauuugauuccugggucaaccaguucuacacacuugccccuaugggaaaugggacggggcguagacgugcauuauaa

SEQ ID NO: 5130 - RNA, 1623 nt, Artificial Sequence
  VP1__Norovirus__AGS08102
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuauaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuaguaccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaauuacacaaugaauuuggcuucucaaaauuggagcaauuaugacccaacagaagaaaucccagccccucuaggaacuccagauuuuguagggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaauucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5131 - RNA, 1623 nt, Artificial Sequence
  VP1__Norovirus__AGS08103
augaagauggcgucgagugacgcccacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguucaagccccugguggagaguucacaguauccccuagaaacgcuccaggugaaauacuauggagcgcgcccuuaggcccugacuugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaucauuauaaucagucaaaugaccccacuaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauccccuuggaaaaguuguucacgggccccaguagugccuuuguuguucaaccacaaaacggcaggugcacgacugauggcgugcuccuagguacuacccagcugucuccugucaacaucugcaccuucagaggggaugucacccacauuucaggcagucguaacuacacaaugaauuuggccucccaaaauuggaacaguuacgacccaacagaagaaaucccagccccccugggaacuccagauuucguggggaagauucaaggcgugcucacccaaaccacaaggacagauggcucgacccgcggccacaaagcuacaguguacacugggagcgccgacuuuucuccaaaacuggguaggguucaauuugccacugacacagacaaugauuuuguaacuaaccaaaacacaaaguucaccccagucgguguuauccaggaugguaguacuaccccccgaaaugaaccccaacaaugggugcuuccaaguuacucaggcagaaacacucauaaugugcaccuggcccccgcuguggcccccacguucccgggcgagcagcuccucuucuucagaucuaccaugcccggaugcagcggguaucccaacauggauuuggacugucugcucccccaggaaugggugcaguauuucuaccaggaggcagccccagcacaaucugauguggcacuguuaagauuuguaaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacgugcauuauaa

SEQ ID NO: 5132 - RNA, 1623 nt, Artificial Sequence; identical to SEQ ID NO: 5125
  VP1__Norovirus__AGS08104

SEQ ID NO: 5133 - RNA, 1623 nt, Artificial Sequence
  VP1__Norovirus__AGS08105
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuagggacuccagauuuuguggggaaaauucaaggugugcucacccaaaccacaagaacagauggcucaacacguggccacaaagcuacaguguacacugggagcgccgauuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaccuggccccugcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5134 - RNA, 1623 nt, Artificial Sequence; identical to SEQ ID NO: 5110
  VP1__Norovirus__AGS08106

SEQ ID NO: 5135 - RNA, 1623 nt, Artificial Sequence
  VP1__Norovirus__AGS08107
augaagauggcgucgagugacgccaacccaucugauggguccacagccaaccucgucccagaggucaacaaugagguuauggcuuuggagcccgugguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuaccugauguuaggaauaauuucuaucauuauaaucaaucaaaugauuccaccaucaaauugauagcaauguuguacacaccacuuagggcuaauaaugccggggaugaugucuucacaguuucuugucgaguucuuacgagaccaucccccgauuuugauuuuauauuucuggugccacccacaguugaaucaagaacuaaaccauucucugucccaauuuuaacuguugaggagaugaccaauucaagguuccccauuccuuuggaaaaguuguucacgggccccaguagugccuuuguuguucaaccacaaaacggcaggugcacgacugauggcgugcuccuagguaccacucagcugucuccugucaacaucugcaccuucagaggggaugucacccauauuccaggcagucacaacuacacaaugaauuuggccucccaaaauuggaacaguuacgauccaacagaagaaaucccagccccucuaggaacuccagauuucguggggaagauucaaggugugcucacucaaaccacuaguacaaauggcucgacccgcggccacaaagcuacaguguacacugggagcgccgacuuuuccccaaaacuggguagaguucaauuugccacugacacaaacaaugauuuugaaacuaaccaaaacacaaaauucaccccagucgguguuauccaggaugguaguacuaccccccgaaaugaaccccaacaaugggugcucccaaguuacucaggcagaaacauucacaaugugcaccuggcccccgcuguagcccccacuuucccgggcgagcagcuccucuucuucagaucuacuaugcccggaugcagcggguaucccaacauggaccuggauugucugcuaccccaggaaugggugcaguacuucuaccaggaggcagccccagcacaaucugauguggcucuguuaagauuugugaauccagacacagguaggguuuuguuugaguguaagcuucauaagucaggcuauguuacaguggcccauacuggccaacaugauuuggucauuccccccaaugguuauuuuagauuugauuccugggucaaccaguucuacacacuugcccccaugggaaaugggacggggcguagacgugcauuauaa

SEQ ID NO: 5136 - RNA, 1623 nt, Artificial Sequence
  VP1__Norovirus__AGS08108
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacuauggagcgcgcccuuaggcccugaucugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuagaaauaauuucuaccauuauaaucagucaaaugaccccaccaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggaaaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaguaguuaugauccaacagaagaaaucccagccccccuaggaacuccagauuucguggggaagauucaaggugugcucacccaaaccacaaggacagacggcucgacccgcggccacaaagcuacaguguacacugggagcgcugacuuuucuccaaaacuggguaggguucaauuugccacugacacagacaaugauuuuguaacuaaccaaaacacaaaguucaccccagucgguguuauccaggaugguaguacuaccccccgaaaugaaccccaacaaugggugcucccaagcuacucaggcagaaacacucauaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaucagguuauguuacaguggcucacacuggccaacaugauuuaguuaucccccccaaugguuauuuuagauuugauuccugggucaaccaguucuacacacuugcccccaugggaaaugggacggggcguagacgugcauuauaa

SEQ ID NO: 5137 - RNA, 1623 nt, Artificial Sequence
  VP1__Norovirus__AGS08109
augaagauggcgucgagugacgccaacccaucugauggguccgcagccaaccucgucccagaggucaauaaugagguuauggcucuggagcccguugcuggugccgccauugcggcaccuguagcgggccaacaaaauguaauugaccccuggauuagaaacaauuuuguacaagccccugguggagaguucacaguguccccuagaaacgcuccaggugaaauacuauggagcgcgcccuuagguccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuuaagccccagccaggucacuauguucccccauauaguaguagauguuagacaacuagaaccugugcugauucccuuacccgaugucaggaauaauuucuaucauuacaaucaaucaaaugacuccacuauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccucuggaaaaguuguucacgggccccagcagugccuuuguuguucaaccacaaaacggcaggugcacgacugauggcgugcuccuaggcaccacccaacugucuccugucaauaucugcaccuucagaggggaugucacccacaucacagguagucguaacuacacaaugaauuuggcuucucaaaauuggaacaauuaugacccaacagaagaaaucccagccccucuagggacuccagauuuuguggggaagauucaaggcaugcucacccaaaccacaaggacagauggcucgacacgcggccacaaagcuacaguguacacugggagcgccgacuuugcuccaaaacuggguagaguucaguuugaaacugacacagaccaugauuuugaagcuaaccaaaacacaaaguucaccccagucgguguuauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaagcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugacuccugggucaaccaguucuacacgcuugcccccaugggaaauggaacggggcguagacguguaguauaa

SEQ ID NO: 5138 - RNA, 1623 nt, Artificial Sequence
  VP1__Norovirus__AGS08110
augaagauggcgucgagugacgccaacccaucugauggguccacagccaaccucgucccagaggucaacaaugagguuauggcuuuggagcccgugguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugacuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagaugucaggcaauuggaaccuguguugauccccuuacccgauguuaggaauaauuucuaccauuauaaucaaucaaaugauuccaccaucaaauugauagcaauguuguacacaccacuuagggcuaauaaugccggggaugaugucuucacaguuucuugucgaguucuuacgagaccaucccccgauuuugauuuuauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguaccacucaacuaucuccugucaacaucugcaccuucagaggggacgucacccauauuccaggcagucauaacuacacaaugaauuuggccucccaaaauuggaacaguuacgauccaacagaagaaaucccagccccucuaggaacuccagauuucguggggaagauucaaggugugcucacucaaaccacuaguacaaauggcucgacccgcggccacaaagcuacaguguacacugggagcgccgacuuuucuccaaaacugggcagaguucaguuugccacugacacaaacaaugauuuugaaacuaaccaaaacacaaaauucaccccagucggcguuauccaggaugguaguacuaccccccgaaaugaaccccaacaaugggugcucccaaguuacucaggcagaaacauucacaaugugcaccuggcccccgcuguggcccccacuuucccgggcgaacagcuccucuucuucagaucuacuaugcccggaugcagcggguaccccaacauggauuuggauugucugcucccccaggaaugggugcaguacuucuaccaggaggcagccccagcacaaucugauguggcccuguuaagauuugugaauccagacacagguaggguuuuguuugaguguaagcuucauaaaucaggcuauguuacaguggcucauacuggccagcaugauuugguuaucccccccaaugguuauuuuagauuugacuccugggucaaccaguucuacacacuugcccccaugggaaaugggacggggcguagacgugcauuauaa

SEQ ID NO: 5139 - RNA, 1623 nt, Artificial Sequence
  VP1__Norovirus__AGS08111
augaagauggcgucgagugacgccaacccaucugauggguccacagccaaucucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguguccccuagaaacgcuccaggugaaauacuauggagcgcgcccuuaggcccugauuugaaucccuaccuuucccauuuggccagaauguacaaugguuaugcagguggcuuugaagugcagguaauccucgcggggaacgcguucaccgccgggaaaaucauauuugcagcagucccaccaaauuuuccaacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaauggcaggugcacgacugauggcgugcuccuagguacuacccaacuguccccugucaacaucugcaccuucagaggggaugucacccauauuccaggcagucguaacuacacaaugaauuuggccucccaaaauuggaacaguuacgauccaacagaagaaaucccagccccucuaggaaccccagauuucguggggaagauucaaggugugcucacccaaaccacaaggacaaauggcucaacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucauaaugugcaccuggcccccgcuguagcccccacuuucccgggcgagcagcuccucuucuucagauccacuaugcccggaugcagcggguaccccaacauggauuuggacugucugcucccccaggaaugggugcaguauuucuaccaagaggcagccccagcacaaucugauguggcucuguuaagauuugugaauccagacacagguaggguuuuguuugaguguaagcuucauaaaucaggcuauguuacaguggcucacacuggccaauaugauuugguuaucccccccaaugguuauuuuagauuugauuccugggucaaccaguucuacacacuugcccccaugggaaaugggacggggcguagacgugcauuauaa

SEQ ID NO: 5140 - RNA, 1623 nt, Artificial Sequence; identical to SEQ ID NO: 5027
  VP1__Norovirus__AGS08112

SEQ ID NO: 5141 - RNA, 1623 nt, Artificial Sequence
  VP1__Norovirus__AGS08113
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucagucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagccguaacuacacaaugaauuuggccucccaaaauuggaacaguuacgauccaacagaagaaaucccagccccccuaggaacuccagauuucgugggaaagauucaagguguacucacccaaaccacaaggacagauggcucgacccgcggccacaaagcuacaguguacacugggagcgccgacuuuucuccaaaacuggguaggguucaauuugccacugacacagacaaugauuuuguaacuaaccaaaacacaaaguucaccccagucgguguuauccaggaugguaguacuaccccccgaaaugaaccccaacaaugggugcucccaaguuacucaggcagaaacacucauaaugugcaccuggcccccgcuguagcccccacuuucccgggcgagcagcuccucuucuucagaucuaccaugcccggaugcagcggguaccccaacauggauuuggacugucugcucccccaggaaugggugcaauauuucuaccaggaagcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaauggagcggggcguagacgugcauuauaa

SEQ ID NO: 5142 - RNA, 1623 nt, Artificial Sequence
  VP1__Norovirus__AGS08114
augaagauggcgucgagugacgccaacccaucugauggguccacagccaaccucgucccagaggucaacaaugagguuauggcuuuggagcccgugguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugacuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagaugucaggcaauuggaaccuguguugauccccuuacccgauguuaggaauaauuucuaccauuauaaucaaucaaaugauuccaccaucaaauugauagcaauguuguacacaccacuuagggcuaauaaugccggggaugaugucuucacaguuucuugucgaguucuuacgagaccaucccccgauuuugauuuuauauuuuuggugccacccacaguugaaucaagaacuaaaccauucucugucccaauuuuaacuguugaggagaugaccaauucaagguuccccauuccuuuggaaaaguuguucacgggccccaguagugccuuuguuguucaaccacaaaacggcaggugcacgacugauggcgugcuccuaggcaccacucaacuaucuccugucaacaucugcaccuucagaggggacgucacccauauuccaggcagucauaacuacacaaugaauuuggccucccaaaauuggaacaguuacgauccaacagaagaaaucccagccccucuaggaacuccagauuucguggggaagauucaaggugugcucacucaaaccacuaguacaaauggcucgacccgcggccacaaagcuacaguguacacugggagcgccgacuuuucuccaaaacugggcagaguucaguuugccacugacacaaacaaugauuuugaaacuaaccaaaacacaaaauucaccccagucggcguuauccaggaugguaguacuaccccccgaaaugaaccccaacaaugggugcucccaaguuacucaggcagaaacauucacaaugugcaccuggcccccgcuguggcccccacuuucccgggcgaacagcuccucuucuucagaucuacuaugcccggaugcagcggguaccccaacauggauuuggauugucugcucccccaggaaugggugcaguacuucuaccaggaggcagccccagcacaaucugauguggcccuguuaagauuugugaauccagacacagguaggguuuuguuugaguguaagcuucauaaaucaggcuauguuacaguggcucauacuggccagcaugauuugguuaucccccccaaugguuauuuuagauuugacuccugggucaaccaguucuacacacuugcccccaugggaaaugggacggggcguagacgugcauuauaa

SEQ ID NO: 5143 - RNA, 1623 nt, Artificial Sequence
  VP1__Norovirus__AGS08115
augaagauggcgucgagugacgccaacccaucugauggguccacagccaaccucgucccagaggucaacaaugagguuauggcuuuggagcccguaguuggugccgcuauugcggcaccuguggcgggccagcaaaauguaauugaccccuggauuagaaacaauuuuguucaagccccugguggagaguucacaguauccccuagaaacgcuccaggugaaauacuauggagcgcgcccuuaggcccugacuugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaucauuauaaucagucaaaugaccccaccaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaacucaagguuccccaucccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaacuuggccucccaaaauuggaacaguuacgacccaacagaagagaucccagccccccugggaacuccagauuucguggggaagauucaaggcgugcucacccaaaccacaaggacagauggcucgacccgcggccacaaagcuacaguguacacugggagcgccgacuuuucuccaaaacuggguaggguucaauuugccacugacacagacaaugauuuuguaacuaaccaaaacacaaaguucaccccagucgguguuauccaggaugguaguacuaccccccgaaaugaaccccaacaaugggugcuuccaaguuacucaggcagaaacacucauaaugugcaccuggcccccgcuguggcccccacguucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccuggguuaaccaguucuacacacuugcccccaugggaaaugggacggggcguagacgugcauuauaa

SEQ ID NO: 5144 - RNA, 1623 nt, Artificial Sequence; identical to SEQ ID NO: 5070
  VP1__Norovirus__AGS08116

SEQ ID NO: 5145 - RNA, 1623 nt, Artificial Sequence
  VP1__Norovirus__AGS08117
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacuauggagcgcgcccuuaggcccugaucugaaucccuaccuuucccauuuggccagaauguacaaugguuaugcaggugguuuugaagugcagguaauccucgcggggaaugcguucaccgccggaaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucagucaaaugaccccaccaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggaaaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaauaguuaugauccaacagaagaaaucccagccccccuaggaacuccagauuucguggggaagauucaagguaugcucacccaaaccacaaggacagacggcucgacccgcggccacaaagcuacaguguacacugggagcgccgacuuuucuccaaaacuggguaggguucaauuugccacugacacagacaaugauuuuguaacuaaccaaaacacaaaguucaccccagucgguguuauccaggaugguaguacuaccccccgaaaugaaccccaacaaugggugcucccaagcuacucaggcagaaacacucauaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacgugcauuauaa

SEQ ID NO: 5146 - RNA, 1623 nt, Artificial Sequence; identical to SEQ ID NO: 5142
  VP1__Norovirus__AGS08119

SEQ ID NO: 5147 - RNA, 1623 nt, Artificial Sequence; identical to SEQ ID NO: 5125
  VP1__Norovirus__AGS08120

SEQ ID NO: 5148 - RNA, 1623 nt, Artificial Sequence; identical to SEQ ID NO: 5142
  VP1__Norovirus__AGS08121

SEQ ID NO: 5149 - RNA, 1623 nt, Artificial Sequence
  VP1__Norovirus__AGS08122
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucagucaaaugaccccaccaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuucccauuccuuuggaaaaguuguucacgggccccaguagugccuucguuguucaaccacaaaacggcaggugcacgacugauggcgugcuccuagguaccacccaacugucuccugucaacaucugcaccuucagaggggaugucacccacauuucaggcagucguaacuacacaaugaauuuggccucccaaaauuggaacaguuacgacccaacagaagaaaucccagccccccuaggaacuccagauuucguggggaagauucaaggugugcucacccaaaccacaaggacagauggcucgacccgcggccacaaagcuacaguguacacugggagcgccgacuuuucuccaaaacuggguaggguucaauuugccacugacacagacaaugauuuuguaacuaaccaaaacacaaaguucaccccagucgguguuauccaggaugguaacacuaccccccgaaaugaaccccaacaaugggugcucccaaguuacucagguagaaacacucauaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguuaagauuugugaauccagacacagguaggguucuguuugaguguaagcuucauaaaccagguuauguuacaguggcucacacuggccaacaugauuuaguuaucccccccaaugguuauuuuagauuugauuccugggucaaccaguucuacacacuugcccccaugggaaaugggacggggcguagacgugcacuauaa

SEQ ID NO: 5150 - RNA, 1623 nt, Artificial Sequence
  VP1__Norovirus__AGS08124
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuucguucaagccccugguggagaguucacaguauccccuagaaacgcuccaggugaaauacuauggagcgcgcccuuaggcccugacuugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaucauuauaaucagucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccaucccuuuggaaaaguuguucacgggccccaguggugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgacccaacagaagagaucccagccccccugggaacuccagauuucguggggaagauucaaggcgugcucacccaaaccacaaggacagauggcucgacccgcggccacaaagcuacaguguacacugggagcgccgacuuuucuccaaaacuggguaggguucaauuugccacugacacagacagugauuuuguaacuaaccaaaacacaaaguucaccccagucgguguuauccaggaugguagcaccaccccccgaaaugaaccucaacaaugggugcuuccaaguuacucaggcagaagcacucauaaugugcaccuggcccccgcuguggcccccacguucccgggugagcagcuccucuucuucagaucuaccaugcccggaugcagcggguaccccaacauggauuuggacugucugcucccccaagaaugggugcaguauuucuaccaggaggcagccccagcgcaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacgugcauuauaa

SEQ ID NO: 5151 - RNA, 1623 nt, Artificial Sequence
  VP1__Norovirus__AGS08125
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagcccuagccaggucacuauguucccccauauaguaguagacguuaggcaacuagaaccuguguugauucccuuacccgauguuaggaauaauuucuaucauuacaaucaaucaaaugaccccacuauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgucuuugcuccaaaacuggguagaguucaauuugaaacugacacagaccaugauuuugaagcuaaccaaaacacaaaguucaccccaguuggugucauacaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5152 - RNA, 1623 nt, Artificial Sequence
  VP1__Norovirus__AGS08126
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacaagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaauuccagccccucuaggaacuccagauuuuguggggaagauucaaggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccagucggugucauccaagaugguggcaccacccaccgaaaugaaccccaacagugggugcucccaaguuacucaggcagaaacacucauaaugugcaucuggcucccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcccacacuggccaacaugauuugguuaucccccccaaugguuauuuuagguuugauuccugggucaaccaguuuuacacgcuugcccccaugggaaauggaacggggcguagacgugcaguauaa

SEQ ID NO: 5153 - RNA, 1623 nt, Artificial Sequence
  VP1__Norovirus__AGS08127
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacuauggagcgcgcccuuaggcccugaucugaaucccuaccuuucccauuuggccagaauguacaaugguuaugcaggugguuuugaagugcagguaauccucgcggggaaugcguucaccgccggaaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucagucaaaugaccccaccaucaaauugauagcaauguuguacacaccacuuagggcuaacaaugccggggacgaugucuucacaguuucuugccgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuaugauccaacagaagaaaucccagccccccuaggaacuccagauuucguggggaagauucaaggugugcucacccaaaccacaaggacagauggcucgacccgcggccacaaagcuacaguguauacugggagcgccgacuuuucuccaaaacuggguaggguucaauuugccacugauacagacaaugauuuuguaacuaaccaaaacacaaaguucaccccagucgguguuauccaggaugguaguacuaccccccgaaaugaaccccaacaaugggugcucccaaguuacucaggcagaaacacucauaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguuaagauuugugaauccagacacagguaggguuuuguuugagugcaagcuucauaaaucaggcuauguuacaguggcucacacuggccaacaugauuuaguuaucccccccaaugguuauuuuagauuugauuccugggucaaccaguucuacacacuugcccccaugggaaacgggacggggcguagacgugcauuauaa

SEQ ID NO: 5154 - RNA, 1623 nt, Artificial Sequence
  VP1__Norovirus__AGS08128
augaagauggcgucgagugacgccaacccaucugauggguccacggccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacuauggagugcgcccuuaggcccugauuugaaucccuaccuuucccauuuggccagaauguacaaugguuaugcgggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaccagucaaaugaccccaccaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacauuugcaccuucagaggggaugucacccacauuccaggcagucguaacuacacaaugaauuuggccucccaaaauuggaacagcuacgacccaacagaagaaaucccagccccccuaggaacuccagauuucguggggaagauucaaggugugcucacccaaaccacaaggacagauggcucgacccgcggccacaaagcuacaguguacacugggagcgccgacuuuucuccaaaacuggguaggguucaauuugccacugacacagacaaugauuuuguaacuaaccaaaacacaaaguucaccccagucgguguuauccaggaugguaguacuaccccccgaaaugaaccccaacaaugggugcucccaaguuacucaggcagaaacacucacaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacgugcauuauaa

SEQ ID NO: 5155 - RNA, 1623 nt, Artificial Sequence
  VP1__Norovirus__AGS08129
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacuauggagcgcgcccuuaggcccugaucugaaucccuaccuuucccaucuggccagaauguacaauggcuaugcaggugguuuugaagugcagguaauccucgcggggaaugcguucaccgccggaaaaaucauauuugcagcagucccaccaaauuucccaacugaagguuugagccccagccaagucacuauguucccccacauaauaguagauguuaggcaauuggaaccuguguugauccccuuacccgauguuagaaauaauuucuaccauuauaaucagucaaaugaccccaccaucaaauugauagcaauguuguacacaccacuuagggcuaauaaugccggggacgaugucuucacaguuucuugucgaguucucacgagaccaucccccgauuuugauuucauauucuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacgguaggugcacgacugauggcgugcuccuagguacuacccaacugucuccugucaacaucugcaccuucagaggggaugucacccacauuucaggcagucauaacuacacaaugaauuuggccucccaaaauuggaacaguuaugauccaacagaagaaaucccagccccccuaggaacuccagauuucguggggaagauucaagguaugcucacccaaaccacaaggacagauggcucgacccgcggccacaaagcuacaguguacacugggagcgucgacuuuucuccaaaacuggguaggguucaauuuaccacugacacagacaaugauuuugaaacuaaccaaaacacaaaguucaccccagucgguguuauccaggaugguaguacuacccaccgaaaugaaccccaacaaugggugcucccaagcuacucaggcagaaacacucauaaugugcaccuggcccccgcuguagcccccacuuucccgggcgagcagcuccucuucuucagauccaccaugcccggaugcagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacgugcauuauaa

SEQ ID NO: 5156 - RNA, 1623 nt, Artificial Sequence
  VP1__Norovirus__AGS08130
augaagauggcgucgagugacgccaacccaucugauggguccacagccaaccucgucccagaggucaacaaugagguuauggcuuuggagcccguaguuggugccgcuauugcggcaccuguggcgggccagcaaaauguaauugaccccuggauuagaaacaauuuuguucaagccccugguggagaguucacaguauccccuagaaacgcuccaggugaaauacuauggagcgcgcccuuaggcccugacuugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaucauuauaaucagucaaaugaccccaccaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccaucccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgacccaacagaagagaucccagccccccugggaacuccagauuucguggggaagauucaaggcgugcucacccaaaccacaagggcagauggcucgacccgcggccacaaagcuacaguguacacugggagcgccgacuuuucuccaaaacuggguaggguucaauuugccacugacacagacaaugauuuuguagcuaaccaaaacacaaaguucaccccagucgguguuauccaggaugguaguacuaccccccgaaaugaaccccaacaaugggugcuuccaaguuacucaggcagaaacacucauaaugugcaccuggcccccgcuguggcccccacguucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacgugcauuauaa

SEQ ID NO: 5157 - RNA, 1623 nt, Artificial Sequence
  VP1__Norovirus__AGS08131
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgccuuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacaagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggaaaugucacccauaucacagguagucguaacuacacaaugaauuuggcuucucaaaauuggaacaauuaugacccaacagaagaaauuccagccccucuaggaacuccagauuuuguggggaagauucaaggcgugcucacccaaaccacaaggacagauggcucaacacgcggccacaaagccacaguguacauugggagcgccgacuuugcuccaaaacuggguagaguucaauuugaaacugacacagaccaugauuuugaagcuaaccaaaacacaaaguucaccccagucggugucauccaagaugguggcaccacccaccgaaaugaaccccaacagugggugcucccaaguuacucaggcagaaacacucauaaugugcaucuggcucccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcccacacuggccaacaugauuugguuaucccccccaaugguuauuuuagguuugauuccugggucaaccaguuuuacacgcuugcccccaugggaaauggaacggggcguagacgugcaguauaa

SEQ ID NO: 5158 - RNA, 1623 nt, Artificial Sequence
  VP1__Norovirus__AGS08132
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucacugccgggaaaaucauauuugcagcagucccaccaaauuucccgacugaagguuugagccccagccaggucacuauguucccccacauaauaguagauguuaggcaauuggaaccuguguugauccccuuacccgauguuaggaacaauuucuaccauuauaaucaaucaaaugaccccaccaucaaauugauagcaauguuguacacaccacuuagggcuaauaaugccggggacgaugucuucacgguuucuugucgaguucucacgagaccaucccccgauuuugauuucauauuuuuggugccacccacaguugaaucaagaacuaaaccauucucuguuccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuucaggcagucauaacuacacaaugaauuuggccucccaaaauuggaacaguuacgauccaacagaagaaaucccagccccucuaggaacuccagauuucguggggaaaauucaaggugugcucacccaaaccacaaggacagauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggauggugguacuacccaccgaaaugaaccccaacaaugggugcucccaaguuacucaggcagaaacauccauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccagcaugauuugguuaucccccccaaugguuauuuuagauuugauuccugggucaaccaguucuacacacuugcccccaugggaaaugggacggggcguagacgugcauuauaa

SEQ ID NO: 5159 - RNA, 1623 nt, Artificial Sequence
  VP1__Norovirus__AGS08133
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguucaagccccugguggagaguuuacaguauccccuagaaacgcuccaggugaaauacuauggagcgcgcccuuaggcccugaucugaaucccuaccuuucccauuuggccagaauguacaaugguuaugcaggugguuuugaagugcagguaauccucgcggggaaugcguucaccgccggaaaaaucauauuugcagcagucccaccaaguuucccaacugaagguuugagccccagccaagucacuauguucccccacauaauaguagauguuaggcaauuggaaccuguguugauccccuuacccgauguuaggaauaauuucuaccauuauaaucagucaaaugaccccaccaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuaugauccaacagaagaaaucccagccccccuaggaacuccagauuucguggggaagauucaaggugugcucacccaaaccacaaggacagauggcucgacccgcggccacaaagcuacaguguacacugggagcgccgacuuuucuccaaaacuggguaggguucaauuugccacugacacagacaaugauuuuguaacuaaccaaaacacaaaguucaccccagucgguguuauccaggaugguaguacuaccccccgaaaugaaccccaacaaugggugcucccaaguuacucaggcagaaacacucauaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacgugcauuauaa

SEQ ID NO: 5160 - RNA, 1623 nt, Artificial Sequence
  VP1__Norovirus__AGS08134
augaagauggcgucgagugacgccaacccaucugauggguccacagccaaccucgucccagaggucaacaaugagguuauggcuuuggagcccgugguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuuuccaacugaagguuugagccccagccaggucacuauguucccccacauaauaguagauguuaggcaauuggaaccuguguugauccccuuacccgauguuaggaauaauuucuaccauuauaaucaaucaaaugauuccaccaucaaauugauagcaauguuguacacaccacuuagggcuaauaaugccggggaugaugucuucacaguuucuugucgaguucucacgagaccaucccccgauuuugauuuuauauuuuuggugccacccacaguugaaucaagaacuaaaccauucucugucccaauuuuaacuguugaggagaugaccaauucaagguuccccauuccuuuggaaaaguuguucacgggccccaguagugccuuuguuguucaaccacaaaacggcaggugcacgacugauggcgugcuccuagguaccacucaacugucuccugucaacgucugcaccuucagaggggaugucacccauauuccaggcagucauaacuacacaaugaauuuggccucccaaaauuggaacaguuacgauccaacagaagaaaucccagccccucuaggaacuccagauuucguggggaagauucaaggugugcucacucaaaccacuaguacaaauggcucgacccgcggccacaaagcuacaguguacacugggagcgccgacuuuucuccaaaacuggguagaguucaauuugccacugacacaaacaaugauuuugaaacuaaccaaaacacaaaauucaccccagucggcguuauccaggaugguagcaccaccccccgaaaugaaccccaacaaugggugcucccaaguuacucagguagaaacauucacaaugugcaccuggcccccgcuguagcccccacuuucccgggcgagcagcuccucuucuucagaucuacuaugcccggaugcagcggguaccccaacauggacuuggauugucugcucccccaggaaugggugcaguauuucuaccaggaggcagccccagcacaaucugauguggcucuguugagauuugugaauccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacgugcauuauaa

SEQ ID NO: 5161 - RNA, 1623 nt, Artificial Sequence
  VP1__Norovirus__AGS08135
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacuauggagcgcgcccuuaggcccugaucugaaccccuaccuuucccauuuggccagaauguacaaugguuaugcaggugguuucgaagugcagguaguccucgcggggaaugcguucaccgccggaaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucagucaaaugaccccaccaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuaugauccaacagaagaaaucccagccccccuagggacuccagauuucguggggaagauucaaggugugcucacccaaaccacaaggacagauggcucgacccgcggccacaaagcuacaguguauacugggagcgccgacuuuucuccaaaacuggguaggguucaauuugccacugacacagacaaugauuuuguaacuaaccaaaacacaaaguucaccccagucgguguuauccaggaugguaguacuaccccccgaaaugaaccccaacaaugggugcucccaaguuacucaggcagaaacacucauaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaacgggacggggcguagacgugcauuauaa

SEQ ID NO: 5162 - RNA, 1623 nt, Artificial Sequence
  VP1__Norovirus__AGS08136
augaagauggcgucgagugacgccaacccaucugauggguccacagccaaccucgucccagaggucaacaaugagguuauggcuuuggagcccgugguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguauaaugguuaugcaggugguuuugaagugcagguaauccucgcggggaacgcguucaccgccgggaaaaucauauuugcagcagucccaccaaauuuuccaacugaagguuugagccccagccaggucacuauguucccccacauaauaguagauguuaggcaauuggaaccuguguugauccccuuacccgauguuaggaauaauuucuaccauuauaaucaaucaaaugauuccaccaucaaauuaauagcaauguuguacacaccacuuagggcuaauaaugccggggaugaugucuucacaguuucuugucgaguucucacgagaccaucccccgauuuugauuuuauauuuuuggugccacccacaguugaaucaagaacuaaaccauucucuguuccaauuuuaacuguugaggagaugaccaauucaagguuccccauuccuuuggaaaaguuguucacgggccccaguagugccuuuguuguucaaccacaaaacggcaggugcacgacugauggcgugcuccuagguaccacucaacugucuccugucaacaucugcaccuucagaggggaugucacccauauuccaggcagucauaacuacacaaugaauuuggccucccaaaauuggaacaguuacgauccaacagaagaaaucccagccccucuaggaacuccagauuucguggggaagauucaaggugugcucacucaaaccacuaguacaaauggcucgacccgcggccacaaagcuacaguguacacugggagcgccgacuuuucuccaaaacuggguagaguucaauuugccacugacacaaacaaugauuuugaaacuaaccaaaacacaaaauucaccccagucggcguuauccaggaugguagcaccaccccccgaaaugaaccccaacaaugggugcucccaaguuacucagguagaaacauucacaaugugcaccuggcccccgcuguagcccccacuuucccgggcgagcagcuccucuucuucagaucuacuaugcccggaugcagcggguaccccaacauggacuuggauugucugcucccccaggaaugggugcaguauuucuaccaggaggcagccccagcacaaucugauguggcucuguugagauuugugaauccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacgugcauuauaa

SEQ ID NO: 5163 - RNA, 1623 nt, Artificial Sequence
  VP1__Norovirus__AGS08137
augaagauggcgucgagugacgccaacccaucugauggguccucagccaaccucgucccagaggucaacaaugagguuauggcuuuggagcccguaguuggugccgcuauugcggcaccuguagcgggccagcaaaauguaauugaccccuggauuagaaacaauuuuguucaagccccugguggagaguucacaguauccccuagaaacgcuccaggugaaauacuauggagcgcgcccuuaggcccugacuugaaucccuaccuuucccauuuggccagaauguacaaugguuaugcaggugguuuugaagugcagguaauccucgcggggaaugcguucaccgccgggaaaaucauauuugcagcagucccaccaaauuucccaaccgaagguuugagccccagccaagucacuauguucccccacauaauaguagauguuaggcaauuggaaccuguguugauccccuuacccgauguuaggaauaauuucuaucauuauaaucagucaaaugaccccacuaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccaucccuuuggaaaaguuauucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgacccaacagaagaaaucccagccccccugggaacuccagauuucguggggaagauucaaggcgugcucacccaaaccacaaggacagauggcucgacccgcggccacaaagcuacaguguacacugggagcgccgacuuuucuccaaaacuggguaggguucaauuugccacugacacagacaaugauuuuguaacuaaccaaaacacaaaguucaccccagucggugucauccaggaugguagcacuaccccccgaaaugaaccccaacaaugggugcuuccaaguuacucaggcagaaacacucauaaugugcaccuggcccccgcuguggcccccacguucccgggcgagcagcuccucuucuucagaucuaccaugcccggaugcagcggguaccccaacauggauuuggacugucugcucccccaggaaugggugcaguauuucuaccaggaggcagccccagcacaaucugauguggcgcuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguaaacgugcauuauaa

SEQ ID NO: 5164 - RNA, 1623 nt, Artificial Sequence
  VP1__Norovirus__AGS08138
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguucacaguguccccuagaaacgcuccaggugaaauacuauggagcgcgcccuuaggcccugauuugaaucccuaucuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaacuuuuaccauuauaaucaaucaaaugacuccaccaucaaauugauagcaaugcuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaacucaagguuccccauuccuuuggaaaaauuguucacgggccccaguagugccuuuguuguucaaccacaaaacggcaggugcacgacugauggcgugcuccuagguaccacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucggcguuauccaggaugguaguacuaccccccgaaaugaaccccaacaaugggugcucccaaguuacucaggcagaaauacucauaaugugcaccuggcccccgcuguagcccccacuuucccgggcgagcagcuucucuucuucagaucuacuaugcccggaugcagcggguaccccaacauggacuuggacugucugcucccccaggaaugggugcaguacuucuaccaggaggcagccccagcacaaucugauguagcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 5165 - RNA, 1623 nt, Artificial Sequence
  VP1__Norovirus__AGS08139
augaagauggcgucgagugacgccaacccaucugauggguccgcagccaaccucgucccagaggucaauaaugagguuauggcucuggagcccguuguuggugccgccauugcggcaccuguagcgggccaacaaaauguaauugaccccuggauuagaaacaauuuuguacaagccccugguggagaguucacaguguccccuagaaacgcuccaggugaaauacuauggagcgcgcccuuagguccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuuaagccccagccaggucacuauguucccccauauaguaguagauguuagacaacuagaaccugugcugauucccuuacccgaugucaggaauaacuucuaucauuacaaucaaucaaaugacuccacuauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccucuggaaaaguuguucacgggccccagcagugccuuuguuguucaaccacaaaacggcaggugcacgacugauggcgugcuccuaggcaccacccaacugucuccugucaauaucugcaccuucagaggggaugucacccacaucacagguagucguaacuacacaaugaauuuggcuucucaaaauuggaacaauuaugacccaacagaagaaaucccagccccucuagggacuccagauuuuguggggaagauucaaggcaugcucacccaaaccacaaggacagauggcucgacacgcggccacaaagcuacaguguacacugggagcgccgacuuugcuccaaaacuggguagaguucaauuugaaacugacacagaccaugauuuugaagcuaaccaaaacacaaaguucaccccagucgguguuauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaagcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguucuacacgcuugcccccaugggaaauggaacggggcguagacguguaguauaa

SEQ ID NO: 5166 - RNA, 1623 nt, Artificial Sequence
  VP1__Norovirus__AGS08140
augaagauggcgucgagugacgccaacccaucugauggguccgcagccaaccucguaccagaggucaacaaugagguuauggcucuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaagaucauauuugcagcagucccaccaaauuuuccaacugaaggcuuaagccccagccaggucacuauguucccccauauaauaguagauguuagacaacuagaaccugugcugauucccuuacccgaugucaggaauaauuucuaucauuacaaucaaucaaaugacuccacuauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccacaaaacggcaggugcacgacugauggcgugcuccuaggcaccacccaacugucuccugucaacaucugcaccuucagaggggaugucacccacaucacagguagucguaacuacacaaugaauuuggcuucucaaaauuggaacaauuaugacccaacagaagaaaucccagccccucuaggaacuccagauuuuguggggaagauucaaggcaugcucacccaaaccacaaggacagaugguucaacacgcggccacaaagcuacaguguacacugggagcgccgacuuugcuccaaaacuggguagaguucaauuugaaacugacacagaccaugauuuugaagcuaaccaaaacacaaaguucaccccagucggugucauccaagaugguggcaccacccaccgaaaugaaccccaacagugggugcucccaaguuacucaggcagaaauacucauaaugugcaucuggcccccgcuguagcccccacuuuuccgggugagcagcuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucaggcuauguuacaguggcucacacuggccaacaugauuugguuaucccccccaaugguuacuuuagguuugauuccugggucaaccaguucuacacgcuugcccccaugggaaauggaacggggcguagacguguaguauaa

SEQ ID NO: 5167 - RNA, 1623 nt, Artificial Sequence
  VP1__Norovirus__AGS08141
augaagauggcgucgagugacgccaacccaucugauggguccgcagccaaccuugucccagaggucaacaaugagguuauggcucuggagcccguuguuggugccgccauugcggcaccuguagcgggccaacaaaaugugauugaccccuggauuagaaauaauuuuguacaagccccugguggagaguuuacaguguccccuagaaacgcuccaggugaaauacuauggagcgcgcccuuaggcccugaucuaaaucccuaccuaucccauuuggccaggauguacaaugguuaugcaggugguuuugaagugcagguaauucucgcggggaacgcguucaccgccgggaaggucauauuugcagcagucccaccaaauuuuccaacugaaggcuuaagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguacacaccacuuagggcuaauaaugcuggggacgaugucuucacagucucgugccgaguucucacaagaccaucccccgacuuugauuucauauuuuuagugccacccacaguugagucaagaacuaaaccauucucugucccaguuuuaacuguugaggagaugaccaauucaagauuccccauuccuuuggaaaaguuguucacgggucccagcagugccuuuguuguacaaccacaaaauggcaggugcacaacugauggcgugcuccuaggcaccacccaacuaucuccugucaacaucugcaccuucagaggggaugucacccauaucacagguagucguaacuacacaaugaauuuggcuucucaaaauuggaacaauuaugacccaacagaagaaaucccagccccucuaggagcuccagauuuuguggggaagauucaaggcaugcucacccaaaccacaaggacagauggcucaacacgcggccacaaagcuacgguguacacugggagcgccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacagucugauguggcucugcuaagauuugugaauccagacacagguaggguuuuguuugaguguaagcuucauaaaucaggcuaugucacaguggcucacacuggucaacaugauuugguuaucccccccaaugguuauuuuagguuugauucuugggucaaccaguucuacacgcuugcccccaugggaaauggaacggggcguagacguguaguauaa

SEQ ID NO: 5168 - RNA, 1623 nt, Artificial Sequence
  VP1__Norovirus__AGS08142
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacaagaccaucccccgauuuugauuucauauuucuagugccacccacaguugagucaagagcuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguaggcgugcaccauaa

SEQ ID NO: 5169 - RNA, 1623 nt, Artificial Sequence; identical to SEQ ID NO: 5092
  VP1__Norovirus__AGS08143

SEQ ID NO: 5170 - RNA, 1623 nt, Artificial Sequence
  VP1__Norovirus__AGS08144
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguaucuccuagaaacgcuccaggugaaauacuauggagcgcgcccuuaggcccugauuugaaucccuaccuuucccauuuggccagaauguacaaugguuaugcagguggcuuugaagugcagguaauccucgcggggaacgcguucaccgccgggaaaaucauauuugcagcagucccaccaaauuucccaacugaagguuugagccccagccaggucacuauguucccccacauaauaguagauguuaggcaguuggaaccuguguugauccccuuacccgauguuaggaauaauuucuaccauuauaaucaaucaaaugaccccaccaucaaauugauagcaauguuguauacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuucguuguucaaccacaaaauggcaggugcacgacugauggcgugcuccuagguacuacccaacuguccccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacgaauggcucgacccgcggccacaaagcuacaguguacacugggagcgccgacuuuucuccaaaacuggguagaguucaauuugccacugacacagauaaugauuuugaaacuaaccaaaacacaaaguucaccccagucgguguuauccaggaugguaguaccaccccccgaaaugaaccccaacaaugggugcucccaaguuacucaggcagaaacauucauaaugugcaccuggcucccgcuguagcccccacuuucccgggugagcagcuucucuucuucagauccacuaugcccggaugcagcggguaccccaacauggauuuggacugucugcucccccaggaaugggugcaguauuucuaccaagaggcagccccagcacaaucugauguggcucuguuaagauuugugaauccagacacagguaggguucuguuugaguguaagcuucauaaaccaggcuauguuacaguggcucacacuggccaacaugauuugguuaucccccccaaugguuauuuuagauuugauuccugggucaaucaguucuacacacuugcccccaugggaaaugggacggggcguagacgugcauuauaa

SEQ ID NO: 5171 - RNA, 1623 nt, Artificial Sequence
  VP1__Norovirus__AGS08145
augaagauggcgucgagugacgccaacccaucugauggguccacagccaaccucgucccagaggucaacaaugagguuauggcuuuggagcccgugguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugacuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagaugucaggcaauuggaaccuguguugauccccuuacccgauguuaggaauaauuucuaccauuauaaucaaucaaaugauuccaccaucaaauugauagcaauguuguacacaccacuuagggcuaauaaugccggggaugaugucuucacaguuucuugucgaguucuuacgagaccaucccccgauuuugauuuuauauuuuuggugccacccacaguugaaucaagaacuaaaccauucucugucccaauuuuaacuguugaggagaugaccaauucaagguuccccauuccuuuggaaaaguuguucacgggccccaguagugccuuuguuguucaaccacaaaacggcaggugcacgacugauggcgugcuccuagguaccacucaacuaucuccugucaacaucugcaccuucagaggggacgucacccauauuccaggcagucauaacuacacaaugaauuuggccucccaaaauuggaacaguuacgauccaacagaagaaaccccagccccucuaggaacuccagauuucguggggaagauucaaggugugcucacucaaaccacuaguacaaauggcucgacccgcggccacaaagcuacaguguacacugggagcgccgacuuuucuccaaaacugggcagaguucaguuugccacugacacaaacaaugauuuugaaacuaaccaaaacacaaaauucaccccagucggcguuauccaggaugguaguacuaccccccgaaaugaaccccaacaaugggugcucccaaguuacucaggcagaaacauucacaaugugcaccuggcccccgcuguggcccccacuuucccgggcgaacagcuccucuucuucagaucuacuaugcccggaugcagcggguaccccaacauggauuuggauugucugcucccccaggaaugggugcaguacuucuaccaggaggcagccccagcacaaucugauguggcccuguuaagauuugugaauccagacacagguaggguuuuguuugaguguaagcuucauaaaucaggcuauguuacaguggcucauacuggccagcaugauuugguuaucccccccaaugguuauuuuagauuugacuccugggucaaccaguucuacacacuugcccccaugggaaaugggacggggcguagacgugcauuauaa

SEQ ID NO: 5172 - RNA, 1623 nt, Artificial Sequence
  VP1__Norovirus__AGS08146
augaagauggcgucgagugacgcccacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguucaagccccugguggagaguucacaguauccccuagaaacgcuccaggugaaauacuauggagcgcgcccuuaggcccugacuugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaucauuauaaucagucaaaugaucccacuaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccaucccuuuggaaaaguuauucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgacccaacagaagaaaucccagccccccugggaacuccagauuucguggggaagauucaaggcgugcucacccaaaccacaaggacagauggcucgacccgcggccacaaagcuacaguguacacugggagcgccgacuuuucuccaaaacuggguaggguucaauuugccacugacacagacaaugauuuuguaacuaaccaaaacacaaaguucaccccagucggugucauccaggaugguagcacuaccccccgaaaugaaccccaacaaugggugcuuccaaguuacucaggcagaaacacucauaaugugcaccuggcccccgcuguggcccccacguucccgggcgagcagcuccucuucuucagaucuaccaugcccggaugcagcggguaccccaacauggauuuggacugucugcucccccaggaaugggugcaguauuucuaccaggaggcagccccagcacaaucugauguggcgcuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacgugcauuauaa

SEQ ID NO: 5173 - RNA, 1623 nt, Artificial Sequence; identical to SEQ ID NO: 5066
  VP1__Norovirus__AGS08147

SEQ ID NO: 5174 - RNA, 1623 nt, Artificial Sequence; identical to SEQ ID NO: 5162
  VP1__Norovirus__AGS08148

SEQ ID NO: 5175 - RNA, 1623 nt, Artificial Sequence
  VP1__Norovirus__AGS08149
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuugugcaagccccugguggagaguuuacaguauccccuagaaacgcuccaggugaaauacuauggaacgcgcccuuaggcccugauuugaaucccuaccuuucccauuuggccagaauguacaaugguuaugcagguggcuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaauggcaagugcacgacugauggcgugcuccuagguacuacccaacuguccccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucauaaugugcaccuggcccccgcuguagcccccacuuucccgggcgagcagcuccucuucuucagauccacuaugcccggaugcagcggguaccccaacauggauuuggacugucugcucccccaggaaugggugcaguauuucuaccaagaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 5176 - RNA, 1623 nt, Artificial Sequence; identical to SEQ ID NO: 5125
  VP1__Norovirus__AGS08150

SEQ ID NO: 5177 - RNA, 1623 nt, Artificial Sequence
  VP1__Norovirus__AGS08152
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugaucuaaauccuuaccuaucccauuuggccagaauguacaauggcuaugcaggugguuuugaagugcagguaauccucgcggggaacgcguucaccgccggaaagaucauauucgcagcagucccaccaaauuucccaacugaaggcuugagccccagccaggucacuauguucccccauauaauaguagauguuaggcaacuggaaccuguguugauucccuuacccgauguuaggaauaauuucuaucauuacaaucaaucaaaugaccccaccaucaaguugauagcaauguuguauacaccacuuagggcuaauaaugcuggggacgacgucuucacaguuucuugccgaguucucacgagaccaucccccgauuuugauuuuauauuuuuagugccacccacaguugagucaagaacuaaaccauucucugucccaguuuuaaccguugaggagaugaccaauucaagguuccccguuccuuuggaaaaguuguucacgggucccagcagugccuuuguuguucaaccacaaaacggcaggugcacgacugauggcgugcuccuagguacuacccaacugucuccugucaacaucugcaccuucagaggggaugucacccauauuacagguagucauaacuacacaaugaauuuggcuucucaaaauuggaacaguuaugacccaacagaagaaaucccagccccucuaggaacuccagauuucguggggaagauucaaggugugcucacccaaaccacaagggcaaauggcucaacacgcggccacaaagcuacaguguacacugggagcgcugacuuugcuccaaaacuggguagaguccaauuugccacugacacaaacaaugauuuugaugcuaaccaaaacacaaaguuuaccccagucggugucauccaggauggugacacugcccaccgaaaugaaccccagcagugggugcucccaaguuacucaggcagaaauagucauaaugugcaucuggcccccgcuguagcccccacuuuuccgggugaacaacuucucuucuucagauccacuaugcccggaugcagcggguaccccaacauggauuuggacugucugcucccccaggaaugggugcaguacuucuaccaagaggcagccccagcacaaucugauguggcucugcuaagguuugugaauccagacacagguaggguuuuguuugaguguaagcuucacaaaucaggcuauguuacaguggcucacacuggccaacaugauuugguuaucccccccaaugguuauuuuagauuugauuccugggucaaccaguucuacacgcuugcccccaugggaaauggaacggggcguagacgugcauuauaa

SEQ ID NO: 5178 - RNA, 1623 nt, Artificial Sequence
  VP1__Norovirus__AGS08153
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugaucuaaauccuuaccuaucccauuuggccagaauguacaauggcuaugcaggugguuuugaagugcagguaauccucgcggggaacgcguucaccgccggaaagaucauauucgcagcagucccaccaaauuucccaacugaaggcuugagccccagccaggucacuauguucccccauauaauaguagauguuaggcaacuggaaccuguguugauucccuuacccgauguuaggaauaauuucuaucauuacaaucaaucaaaugaccccaccaucaaguugauagcaauguuguauacaccacuuagggcuaauaaugcuggggacgacgucuucacaguuucuugccgaguucucacgagaccaucccccgauuuugauuuuauauuuuuagugccacccacaguugagucaagaacuaaaccauucucugucccaguuuuaaccguugaggagaugaccaauucaagguuccccguuccuuuggaaaaguuguucacgggucccagcagugccuuuguuguucaaccacaaaacggcaggugcacgacugauggcgugcuccuagguacuacccaacugucuccugucaacaucugcaccuucagaggggaugucacccauauuacagguagucauaacuacacaaugaauuuggcuucucaaaauuggaacaguuaugacccaacagaagaaaucccagccccucuaggaacuccagauuucguggggaagauucaaggugugcucacccaaaccacaagggcagauggcucaacacgcggccacaaagcuacaguguacacugggagcgcugacuuugcuccaaaacuggguagaguccaauuugccacugacacaaacaaugauuuugaugcuaaccaaaacacaaaguuuaccccagucggugucauccaggauggugacacugcccaccgaaaugaaccccagcagugggugcucccaaguuacucaggcagaaauagucauaaugugcaucuggcccccgcuguagcccccacuuuuccgggugaacaacuucucuucuucagauccacuaugcccggaugcagcggguaccccaacauggauuuggacugucugcucccccaggaaugggugcaguacuucuaccaagaggcagccccagcacaaucugauguggcucugcuaagguuugugaauccagacacagguaggguuuuguuugaguguaagcuucacaaaucaggcuauguuacaguggcucacacuggccaacaugauuugguuaucccccccaaugguuauuuuagauuugauuccugggucaaccaguucuacacgcuugcccccaugggaaauggaacggggcguagacgugcauuauaa

SEQ ID NO: 5179 - RNA, 1623 nt, Artificial Sequence
  VP1__Norovirus__AGS08154
augaagauggcgucgagugacgccaacccaucugauggguccgcagccaaccucguaccagaggucaacaaugagguuauggcuuuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggcuagaauguacaaugguuaugcaggugguuuugaaguggagguaauucucgcggggaacgcguucaccgccgggaagaucauauuugcagcagucccaccaaauuuuccaacugaaggcuuaagccccagccaggucacuauguucccccauauaauaguagauguuagacaacuagaaccugugcugauucccuuacccgaugucaggaauaauuucuaucauuacaaucaaucaaaugacuccacuauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccacaaaacggcaggugcacgacugauggcgugcuccuaggcaccacccaacugucuccugucaacaucugcaccuucagaggggaugucacccacaucacagguagucguaacuacacaaugaauuuggcuucucaaaauuggaacaauuaugacccaacagaagaaaucccagccccucuaggaacuccagauuuuguggggaagauucaaggcacgcucacccaaaccacaaggacagaugguucaacacgcggccacaaagcuacaguguacacugggagugccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucaggcuauguuacaguggcucacacuggccaacaugauuugguuaucccccccaaugguuacuuuagguuugauuccugggucaaccaguucuacacgcuugcccccaugggaaauggaacggggcguagacguguaguauaa

SEQ ID NO: 5180 - RNA, 1623 nt, Artificial Sequence; identical to SEQ ID NO: 5087
  VP1__Norovirus__AGS08157

SEQ ID NO: 5181 - RNA, 1623 nt, Artificial Sequence
  VP1__Norovirus__AGS08158
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccacuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaacuucuaucauuacaaccaaucaaaugaccccaccauaaaguugauagcaauguuguauacaccacuuagggcuaauaaugcuggggaugaugucuucacaguuucuugccgaguucucacgagaccaucccccgauuuugauuucauauuccuagugccacccacaguugagucaagaacuaaaccauucucugucccaguuuuaacuguugaggagaugaccaauucaagauuccccauuccuuuggaaaaguuguucacgggucccagcagugccuuuguuguucaaccacaaaacggcaggugcacgacugauggcgugcuccuaggcaccacccaacuguccccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuucgcuccaaaacuggguagaguucaauuugaaacugacacagaccaugauuuugaagcuaaccaaaacacaaaguucaccccagucggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguucuacacgcuugcccccaugggaaauggaacggggcguagacguguaauauaa

SEQ ID NO: 5182 - RNA, 1623 nt, Artificial Sequence
  VP1__Norovirus__AGS08160
augaagauggcgucgagugacgccaacccaucugauggguccgcagccaaccucgucccagaggucaacaaugagguuauggcucuggagcccguuguuggugccgccauugcggcaccuguagcgggccagcaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauagugguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugauguauucacaguuucuugccgaguucucacgagaccaucccccgauuuugauuucauauuucuagugccacccacaguugagucaagaaccaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacguggccacaaagcuacaguguacacugggagcgccgauuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggccccugcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5183 - RNA, 1623 nt, Artificial Sequence
  VP1__Norovirus__AGS08161
augaagauggcgucgagugacgccaacccaucugauggguccgcagccaaccucguaccagaggucaacaaugagguuauggcucuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaagaucauauuugcagcagucccaccaaauuuuccaacugaaggcuuaagccccagccaggucacuauguucccccauauaauaguagauguuagacaacuagaaccugugcugauucccuuacccgaugucaggaauaauuucuaucauuacaaucaaucaaaugacuccacuauuaaguugauagcaauguuguauacaccacuuagggccaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccacaaaacggcaggugcacgacugauggcgugcuccuaggcaccacccaacugucuccugucaacaucugcaccuucagaggggaugucacccacaucacagguagucguaacuacacaaugaauuuggcuucucaaaauuggaacaauuaugacccaacagaagaaaucccagccccucuaggaacuccagauuuuguggggaagauucaaggcaugcucacccaaaccacaaggacagaugguucaacacgcggccacaaagcuacaguguacacugggagcgccgacuuugcuccaaaauuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccgggugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucaggcuaugucacaguggcucacacuggccaacaugauuugguuaucccccccaaugguuacuuuagguuugauuccugggucaaucaguucuacacgcuugcccccaugggaaauggaacggggcguagacgugcaguauaa

SEQ ID NO: 5184 - RNA, 1623 nt, Artificial Sequence
  VP1__Norovirus__AGS08162
augaagauggcgucgagugacgccaacccaucugauggguccgcagccaaccucguaccagaggucaacaaugagguuauggcuuuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaagaucauauuugcagcagucccaccaaauuuuccaacugaaggcuuaagccccagccaggucacuauguucccccauauaauaguagauguuagacaacuagaaccugugcugauucccuuacccgaugucaggaauaauuucuaucauuacaaucaaucaaaugacuccacuauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccacaaaacggcaggugcacgacugauggcgugcuccuaggcaccacccaacugucuccugucaacaucugcaccuucagaggggaugucacccacaucacagguagucguaacuacacaaugaauuuggcuucucaaaauuggaacaauuaugacccaacagaagaaaucccagccccucuaggaacuccagauuuuguggggaagauucaaggcaugcucacccaaaccacaaggacagaugguucaacacgcggccacaaagcuacaguguacacugggagugccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucaggcuauguuacaguggcucacacuggccaacaugauuugguuaucccccccaaugguuacuuuagguuugauuccugggucaaccaguucuacacgcuugcccccaugggaaauggaacggggcguagacguguaguauaa

SEQ ID NO: 5185 - RNA, 1623 nt, Artificial Sequence
  VP1__Norovirus__AGS08163
augaagauggcgucgagugacgccaacccaucugauggguccgcagccaaccucguaccagaggucaacaaugagguuauggcuuuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaagaucauauuugcagcagucccaccaaauuuuccaacugaaggcuuaagccccagccaggucacuauguucccccauauaauaguagauguuagacaacuagaaccugugcugauucccuuacccgaugucaggaauaauuucuaucauuacaaucaaucaaaugacuccacuauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccacaaaacggcaggugcacgacugauggcgugcuccuaggcaccacccaacugucuccugucaacaucugcaccuucagaggggaugucacccacaucacagguagucguaacuacacaaugaauuuggcuucucaaaauuggaacaauuaugacccaacagaagaaaucccagccccucuaggaacuccagauuuuguggggaagauucaaggcaugcucacccaaaccacaaggacagaugguucaacacgcggccacaaagcuacaguguacacugggagugccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguacccuaacauggauuuggacugucugcucccccaggagugggugcaguacuucuaccaagaggcagccccagcacaaucugauguggcucugcuaagauuugugaauccagacacagguaggguuuuguuugaguguaagcuucacaaaucaggcuauguuacaguggcucacacuggccaacaugauuugguuaucccccccaaugguuacuuuagguuugauuccugggucaaccaguucuacacgcuugcccccaugggaaauggaacggggcguagacguguaguauaa

SEQ ID NO: 5186 - RNA, 1623 nt, Artificial Sequence; identical to SEQ ID NO: 5152
  VP1__Norovirus__AGS08164

SEQ ID NO: 5187 - RNA, 1623 nt, Artificial Sequence
  VP1__Norovirus__AGS08165
augaagauggcgucgagugacgccaacccaucugauggguccgcagccaaccucguaccagaggucaacaaugagguuauggcuuuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaaguggagguaauucucgcggggaacgcguucaccgccgggaagaucauauuugcagcagucccaccaaauuuuccaacugaaggcuuaagccccagccaggucacuauguucccccauauaauaguagauguuagacaacuagaaccugugcugauucccuuacccgaugucaggaauaauuucuaucauuacaaucaaucaaaugacuccacuauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccacaaaacggcaggugcacgacugauggcgugcuccuaggcaccacccaacugucuccugucaacaucugcaccuucagaggggaugucacccacaucacagguagucguaacuacacaaugaauuuggcuucucaaaauuggaacaauuaugacccaacagaagaaaucccagccccucuaggaacuccagauuuuguggggaagauucaaggcaugcucacccaaaccacaaggacagaugguucaacacgcggccacaaagcuacaguguacacugggagugccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucaggcuauguuacaguggcucacacuggccaacaugauuugguuaucccccccaaugguuacuuuagguuugauuccugggucaaccaguucuacacgcuugcccccaugggaaauggaacggggcguagacguguaguauaa

SEQ ID NO: 5188 - RNA, 1623 nt, Artificial Sequence
  VP1__Norovirus__AGS08166
augaagauggcgucgagugacgccaacccaucugauggguccgcagccaaccucguaccagaggucaacaaugagguuauggcuuuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaagaucauauuugcagcagucccaccaaauuuuccaacugaaggcuuaagccccagccaggucacuauguucccccauauaauaguagauguuagacaacuagaaccugugcugauucccuuacccgaugucaggaauaauuucuaucauuacaaucaaucaaaugacuccacuauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccacaaaacggcaggugcacgacugauggcgugcuccuaggcaccacccaacugucuccugucaacaucugcaccuucagaggggaugucacccacaucacagguagucguaacuacacaaugaauuuggcuucucaaaauuggaacaauuaugacccaacagaagaaaucccagccccuuuaggaacuccagauuuuguggggaagauucaaggcaugcucacccaaaccacaaggacagaugguucaacacgcggccacaaagcuacaguguacacugggagugccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucaggcuauguuacaguggcucacacuggccaacaugauuugguuaucccccccaaugguuacuuuagguuugauuccugggucaaccaguucuacacgcuugcccccaugggaaauggaacggggcguagacguguaguauaa

SEQ ID NO: 5189 - RNA, 1623 nt, Artificial Sequence
  VP1__Norovirus__AGS08167
augaagauggcgucgagugacgccaacccaucugauggguccgcagccaaccucguaccagaggucaacaaugagguuauggcucuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaagaucauauuugcagcagucccaccaaauuuuccaacugaaggcuuaagccccagccaggucacuauguucccccauauaauaguagauguuagacaacuagaaccugugcugauucccuuacccgaugucaggaauaauuucuaucauuacaaucaaucaaaugacuccacuauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcaaugccuuuguuguucaaccacaaaacggcaggugcacgacugauggcgugcuccuaggcaccacccaacugucuccugucaacaucugcaccuucagaggggaugucacccacaucacagguagucguaacuacacaaugaauuuggcuucucaaaauuggaacaauuaugacccaacagaagaaaucccagccccucuaggaacuccagauuuuguggggaagauucaaggcaugcucacccaaaccacaaggacagaugguucaacacgcggccacaaagcuacaguguacacugggagcgccgacuuugcuccaaaacuggguagaguucaauuugaaacugacacagaccaugauuuugaagcuaaccaaaacacaaaguuuaccccagucggugucauccaagaugguagcacuacccaccgaaaugaaccccaacagugggugcucccaaguuacucaggcagaaauacucauaauguacaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucaggcuauguuacaguggcucacacuggccaacaugauuugguuaucccccccaaugguuacuuuagguuugauuccugggucaaccaguucuacacgcuugcccccaugggaaauggaacggggcguagacguguaguauaa

SEQ ID NO: 5190 - RNA, 1623 nt, Artificial Sequence
  VP1__Norovirus__AGS08168
augaagauggcgucgagugacgccaacccaucugauggguccgcagccaaccuuguaccagaggucaacaaugagguuauggcuuuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaaguggagguaauucucgcggggaacgcguucaccgccgggaagaucauauuugcagcagucccaccaaauuuuccaacugaaggcuuaagccccagccaggucacuauguucccccauauaauaguagauguuagacaacuagaaccugugcugauucccuuacccgaugucaggaauaauuucuaucauuacaaucaaucaaaugacuccacuauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccacaaaacggcaggugcacgacugauggcgugcuccuaggcaccacccaacugucuccugucaacaucugcaccuucagaggggaugucacccacaucacagguagucguaacuacacaaugaauuuggcuucucaaaauuggaacaauuaugacccaacagaagaaaucccagccccucuaggaacuccagauuuuguggggaagauucaaggcaugcucacccaaaccacaaggacagaugguucaacacgcggccacaaagcuacaguguacacugggagugccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucaggcuauguuacaguggcucacacuggccaacaugauuugguuaucccccccaaugguuacuuuagguuugauuccugggucaaccaguucuacacgcuugcccccaugggaaauggaacggggcguagacguguaguauaa

SEQ ID NO: 5191 - RNA, 1623 nt, Artificial Sequence
  VP1__Norovirus__AGS08169
augaagauggcgucgagugacgccaacccaucugauggguccgcagccaaccucguaccagaggucaacaaugagguuauggcuuuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaagaucauauuugcagcagucccaccaaauuuuccaacugaaggcuuaagccccagccaggucacuauguucccccauauaauaguagauguuagacaacuagaaccugugcugauucccuuacccgauaucaggaauaauuucuaucauuacaaucaaucaaaugacuccacuauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccacaaaacggcaggugcacgacugauggcgugcuccuaggcaccacccaacugucuccugucaacaucugcaccuucagaggggaugucacccacaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagaugguucaacacgcggccacaaagcuacaguguacacugggagugccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucaggcuauguuacaguggcucacacuggccaacaugauuugguuaucccccccaaugguuacuuuagguuugauuccugggucaaccaguucuacacgcuugcccccaugggaaauggaacggggcguagacguguaguauaa

SEQ ID NO: 5192 - RNA, 1623 nt, Artificial Sequence
  VP1__Norovirus__AGS08170
augaagauggcgucgagugacgccaacccaucugauggguccgcagccaaccucguaccagaggucaacaaugagguuauggcuuuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaagaucauauuugcagcagucccaccaaauuuuccaacugaaggcuuaagccccagccaggucacuauguucccccauauaauaguagauguuagacaacuagaaccugugcugauucccuuacccgaugucaggaauaauuucuaucauuacaaucaaucaaaugacuccacuauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauuuucugucccaguuuuaacuguugaggagaugaccaauucaagauuccccauuccuuuggaaaaguuguucacgggccccagcagugccuuuguuguucaaccacaaaacggcaggugcacgacugauggcgugcuccuaggcaccacccaacugucuccugucaacaucugcaccuucagaggggaugucacccacaucacagguagucguaacuacacaaugaauuuggcuucucaaaauuggaacaauuaugacccaacagaagaaaucccagccccucuaggaacuccagauuuuguggggaagauucaaggcaugcucacccaaaccacaaggacagaugguucaacacgcggccacaaagcuacaguguacacugggagugccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucaggcuauguuacaguggcucacacuggccaacaugauuugguuaucccccccaaugguuacuuuagguuugauuccugggucaaccaguucuacacgcuugcccccaugggaaauggaacggggcguagacguguaguauaa

SEQ ID NO: 5193 - RNA, 1623 nt, Artificial Sequence
  VP1__Norovirus__AGS08171
augaagauggcgucgagugacgccaacccaucugauggguccgcagccaaccucguaccagaggucaacaaugagguuauggcucuggaucccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaagaucauauuugcagcagucccaccaaauuuuccaacugaaggcuuaagccccagccaggucacuauguucccccauauaauaguagauguuagacaacuagaaccugugcugauucccuuacccgaugucaggaauaauuucuaucauuacaaucaaucaaaugacuccacuauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccacaaaacggcaggugcacgacugauggcgugcuccuaggcaccacccaacugucuccugucaacaucugcaccuucagaggggaugucacccacaucacagguagucguaacuacacaaugaauuuggcuucucaaaauuggaacaauuaugacccaacagaagaaaucccagccccucuaggaacuccagauuuuguggggaagauucaaggcaugcucacccaaaccacaaggacagaugguucaacacgcggccacaaagcuacaguguacacugggagcgccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccgggugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucaggcuaugucacaguggcucacacuggccaacaugauuugguuaucccccccaaugguuacuuuagguuugauuccugggucaaccaguucuacacgcuugcccccaugggaaauggaacggggcguagacguguaguauaa

SEQ ID NO: 5194 - RNA, 1623 nt, Artificial Sequence
  VP1__Norovirus__AGS08172
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuuggguccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauauuacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccagucggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucuacucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcaguauaa

SEQ ID NO: 5195 - RNA, 1623 nt, Artificial Sequence; identical to SEQ ID NO: 5187
  VP1__Norovirus__AGS08173

SEQ ID NO: 5196 - RNA, 1623 nt, Artificial Sequence
  VP1__Norovirus__AGS08174
augaagauggcgucgagugacgccaacccaucugauggguccgcagccaaccucguaccagaggucaacaaugagguuauggcuuuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaagaucauauuugcagcagucccaccaaauuuuccaacugaaggcuuaagccccagccaggucacuauguuuccccauauaauaguagauguuagacaacuagaaccugugcugauucccuuacccgaugucaggaauaauuucuaucauuacaaucaaucaaaugacuccacuauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccgcaaaacggcaggugcacgacugauggcgugcuccuaggcaccacccaacugucuccugucaacaucugcaccuucagaggggaugucacccacaucacagguagucguaacuacacaaugaauuuggcuucucaaaauuggaacaauuaugacccaacagaagaaaucccagccccucuaggaacuccagauuuuguggggaagauucaaggcaugcucacccaaaccacaaggacagaugguucaacacgcggccacaaagcuacaguguacacugggagugccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucacaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucaggcuauguuacaguggcucacacuggccaacaugauuugguuaucccccccaaugguuacuuuagguuugauuccugggucaaccaguucuacacgcuugcccccaugggaaauggaacggggcguagacguguaguauaa

SEQ ID NO: 5197 - RNA, 1623 nt, Artificial Sequence
  VP1__Norovirus__AGS08175
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccucuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguuuuacacgcuugcccccaugggaaauggaacggggcguagacgugcacuauaa

SEQ ID NO: 5198 - RNA, 1623 nt, Artificial Sequence; identical to SEQ ID NO: 5184
  VP1__Norovirus__AGS08176

SEQ ID NO: 5199 - RNA, 1623 nt, Artificial Sequence; identical to SEQ ID NO: 5187
  VP1__Norovirus__AGS08177

SEQ ID NO: 5200 - RNA, 1623 nt, Artificial Sequence; identical to SEQ ID NO: 5184
  VP1__Norovirus__AGS08178

SEQ ID NO: 5201 - RNA, 1623 nt, Artificial Sequence
  VP1__Norovirus__AGS08179
augaagauggcgucgagugacgccaacccaucugauggguccgcagccaaccucguaccagaggucaacaaugagguuauggcuuuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaagaucauauuugcagcagucccaccaaauuuuccaacugaaggcuuaagccccagccaggucacuauguuuccccauauaauaguagauguuagacaacuagaaccugugcugauucccuuacccgaugucaggaauaauuucuaucauuacaaucaaucaaaugacuccacuauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccgcaaaacggcaggugcacgacugauggcgugcuccuaggcaccacccaacugucuccugucaacaucugcaccuucagaggggaugucacccacaucacagguagucguaacuacacaaugaauuuggcuucucaaaauuggaacaauuaugacccaacagaagaaaucccagccccucuaggaacuccagauuuuguggggaagauucaaggcaugcucacccaaaccacaaggacagaugguucaacacgcggccacaaagcuacaguguacacugggagugccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucacaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucaggcuacguuacaguggcucacacuggccaacaugauuugguuaucccccccaaugguuacuuuagguuugauuccugggucaaccaguucuacacgcuugcccccaugggaaauggaacggggcguagacguguaguauaa

SEQ ID NO: 5202 - RNA, 1623 nt, Artificial Sequence
  VP1__Norovirus__AGS08180
augaagauggcgucgagugacgccaacccaucugauggguccgcagccaaccucguaccagaggucaacaaugagguuauggcuuuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaagaucauauuugcagcagucccaccaaauuuuccaacugaaggcuuaagccccagccaggucacuauguucccccauauaauaguagauguuagacaacuagaaccugugcugauucccuuacccgaugucaggaauaauuucuaucauuacaaucaaucaaaugauuccacuauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccacaaaacggcaggugcacgacugauggcgugcuccuaggcaccacccaacugucuccugucaacaucugcacuuucagaggggaugucacccacaucacagguagucguaacuacacaaugaauuuggcuucucaaaauuggaacaauuaugacccaacagaagaaaucccagccccucuaggaacuccagauuuuguggggaagauucaaggcaugcucacccaaaccacaaggacagaugguucaacacgcggccacaaagcuacaguguacacugggagugccgacuuugcuccaaaacuggguagaguucaauuugaaacugacacagaccaugauuuugaagcuaaccaaaacacaaaguucaccccagucggugucauccaagacgguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucaggcuauguuacaguggcucacacuggccaacaugauuugguuaucccccccaaugguuacuuuagguuugauuccugggucaaccaguucuacacgcuugcccccaugggaaauggaacggggcguagacguguaguauaa

SEQ ID NO: 5203 - RNA, 1623 nt, Artificial Sequence
  VP1__Norovirus__AGS08181
augaagauggcgucgagugacgccaacccaucugauggguccgcagccaaccucguaccagaggucaacaaugagguuauggcuuuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaaguggagguaauucucgcggggaacgcguucaccgccgggaagaucauauuugcagcagucccaccaaauuuuccaacugaaggcuuaagccccagccaggucacuauguucccccauauaauaguagauguuagacaacuagaaccugugcugauucccuuacccgaugucaggaauaauuucuaucauuacaaucaaucaaaugacuccacuauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccacaaaacggcaggugcacgacugauggcgugcuccuaggcaccacccagcugucuccugucaacaucugcaccuucagaggggaugucacccacaucacagguagucguaacuacacaaugaauuuggcuucucaaaauuggaacaauuaugacccaacagaagaaaucccagccccucuaggaacuccagauuuuguggggaagauucaaggcaugcucacccaaaccacaaggacagaugguucaacacgcggccacaaagcuacaguguacacugggagugccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguagggucuuguuugaguguaagcuucacaaaucaggcuauguuacaguggcucacacuggccaacaugauuugguuaucccccccaaugguuacuuuagguuugauuccugggucaaccaguucuacacgcuugcccccaugggaaauggaacggggcguagacguguaguauaa

SEQ ID NO: 5204 - RNA, 1623 nt, Artificial Sequence
  VP1__Norovirus__AGS08182
augaagauggcgucgagugacgccaacccaucugauggguccgcagccaaccucguaccagaggucaacaaugagguuauggcuuuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaaguggagguaauucucgcggggaacgcguucaccgccgggaagaucauauuugcagcagucccaccaaauuuuccaacugaaggcuuaagccccagccaggucacuauguucccccauauaauaguagauguuagacaacuagaaccugugcugauucccuuacccgaugucaggaauaauuucuaucauuacaaucaaucaaaugacuccacuauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccacaaaacggcaggugcacgacugauggcgugcuccuaggcaccacccagcugucuccugucaacaucugcaccuucagaggggaugucacccacaucacagguagucguaacuacacaaugaauuuggcuucucaaaauuggaacaauuaugacccaacagaagaaaucccagccccucuaggaacuccagauuuuguggggaagauucaaggcaugcucacccaaaccacaaggacagaugguucaacacgcggccacaaagcuacaguguacacugggagugccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucaggcuauguuacaguggcucacacuggccaacaugauuugguuaucccccccaaugguuacuuuagguuugauuccugggucaaccaguucuacacgcuugcccccaugggaaauggaacggggcguagacguguaguauaa

SEQ ID NO: 5205 - RNA, 1647 nt, Artificial Sequence
  VP1__Norovirus__AGT39181
augaagauggcgucgaaugacgccacuccaucuaaugauggugccgccggccucgucccagagaucaacaaugaggcaauggcgcuagauccaguggcgggcgcagcgauagcagcaccccucacuggccagcaaaauauaauugaucccuggauuaugaauaauuuugugcaagcaccugguggugaguuuacagugucuccuaggaauuccccuggugaagugcuccucaauuuggaacugggcccagaaauaaaccccuaucuggcccaucuugcuagaauguauaaugguuaugcagguggguuugaagugcagguaguccuagcuggaaaugcguuuacagcaggaaagauaaucuuugcagcuauacccccuaacuucccaauugacaaucuaagcgcagcacagaucacaaugugcccacaugugauuguggaugucagacaguuggaaccggucaaccuuccgaugccugacguucgcaauaacuucuuccacuacaaccaagggucugauucgagauugcgcuuaguugcaauguuguauacaccucuuagggcaaauaauucuggggaugauguuuucacugugucuuguagagugcuaacuaggccuagcccugacuuuucauuuaacuuccuugugccacccacuguggagucaaagacaaaacccuucacccucccuauucugacuaucucugaaaugucuaauucuagguuuccagugccgauugauucucugcacaccagcccaacugagaauauuguuguccagugccaaaaugggcgcgucacucuugauggugaguugaugggcaccacccaacucuuaccuagucaaaucugugcuuuuaggggcgugcucaccagaucaacaagcagggcuagugaccaggccgacacagcaaccccuagauuguuuaauuauuauuggcacauacaauuggauaaucuaaaugggacuccuuaugauccugcagaagacauaccaggcccccuggggacaccagauuuccggggcaaagucuuuggcguggccagccaaagaaaccccgacaguacaacuagagcacaugaagcgaagguggacacaacagcuggucgcuucaccccaaaacuaggcucauuagagauauccacugaaucuggugacuuugaucaaaaccaaccaacaagauucaccccaguuggcauugggguugaccgcgaggcagacuuccaacaaugguccuuacccgacuauucuggucaguucacucacaacaugaacuuagccccagcuguugcucccaacuucccuggugagcagcuccuuuucuuccgcucacaguuaccaucuucuggcgggcgauccaaugggauucuagacugccuggucccccaagaauggguucagcacuucuaccaagaaucggcccccgcccaaacccagguggcccugguuagauaugucaacccugacacugguagaguguuguuugaggccaagcugcacaaauuagguuucaugacuauagcuaagaauggugacucuccaauaacuguucccccaaauggauacuuuagguuugaaucuugggugaacccauuuuacacacuugcccccaugggaacugggaaugggcguagaaggauucaauaa

SEQ ID NO: 5206 - RNA, 1608 nt, Artificial Sequence
  VP1__Norovirus__AGT39191
augaagauggcgucgaaugacgccgcuccaucuaaugauggugcagccggucucguaccagaggucacaaaugagaccauggcacuugaaccgguggcuagggcuucaauagccgccccacucaccggucaaaauaauguuauagaccccuggauuacauuaaacuuugggcaagcucccacuggacaucuuacccuuucaccccccuauucgccuggggaaguccuacuaaacuuggaauuacgcccugaacuaaauccauauuuggcuaaccuuuccagaauguacaaugguuaugcagguggaguugaggugcaaguacuacuggcugggaacgcguucacggcuggaaaacugguauucgccgcaguucccccucauuuuccauuagaaaacauaagcccuggccaaauaaccauguucccucauguaauuauugauguuaggacuuuagaaccaguccuauugccucuuccagauguuaggaacaauuucuuucacuacaaucagcaaaacgaaccgaggaugaggcuuguggcaaugcucuauaccccccuuaggucuaaugguucuggugaugauguauuuacugucuccuguagagugcuuacucgacccucuccugauuuugauuucaauuauuugguacccccuacaguugaaucuaaaacuaaacccuucacacuccccaucuuaaccauaggggaguuaaccaauuccagauucccugugccuauagaugaacucuacacuagccccaaugagaguuuggugguacaaccccagaacgggagaugcgcgcuggauggggaguugcaggguacuacucagcuccuccccacggcgaucugcucguucaggggucggauuaaucagaaagugaguggagagaaccauguuuggaauaugcaaaucaccaacauuaacggaaccccuuuugauccaacagaggauguuccagcuccucuagguacaccagacuuuucuggcaagcucuuuggcguccuaagccagagggaccaugauaaugccuguaggagccaugaugcagugauugcaacuaauucugcuaaauuuaccccaaaauugggcgcuauacaaauuggcacaugggaacaagaugauguacacaucaaccaacccaccaaauuuacuccaguuggcuuguuugaaagugaagguuuuaaucaguggacacucccuaauuauucuggagccuuaacacucaacaugggguuggcccccccuguggcccccacauuuccuggcgagcaaauucuuuucuucagaucccacauuccucuuaaaggagguguggcagacccaguuauugauugucucuugccccaagaguggauccaacaccuuuaucaggagucagccccuucacaaacagauguagcacugaucagauucacaaauccagacacagggcguguccuauuugaagcaaaauugcacaggaguggcuacaucacaguggccaacacugguagcagaccaaucguggugccagcuaaugguuacuucagguuugacucuuggguuaaucaguuuuauucucucgcccccaugggaacugggaaugggcgcagaagggugcaguaa

SEQ ID NO: 5207 - RNA, 1608 nt, Artificial Sequence
  VP1__Norovirus__AGT39194
augaagauggcgucgaaugacgccgcuccaucuaaugauggugcagccggucucguaccagaggucaacaaugagaccauggcacuugaaccgguggcuggggcuucaauagccgccccacucaccggucaaaauaauguuauagaccccuggauuagauuaaacuuugugcaagcucccaauggagaguuuacaguuucaccccgcaauucgccuggggaaguccuacuaaacuuggaauuaggcccugaacuaaauccauauuuggcacaccuuuccagaauguacaaugguuaugcagguggaguugaggugcaaguacuacuggcugggaacgcguucacggcuggaaaacugguauucgccgcaguucccccucauuuuccauuagaaaacauaagcccuggccaaauaaccauguucccucauguaauuauugauguuaggacuuuagaaccaguccuauugccucuuccagauguuaggaacaauuucuuucacuacaaucagcaaaacgaaccgaggaugaggcuuguggcaaugcucuauaccccccuuaggucuaaugguucuggugaugauguauuuacugucuccugcagagugcuuacucgacccucuccugauuuugauuucaauuauuugguacccccuacaguugaaucuaaaacuaaacccuucacacuccccaucuugaccauaggggaguuaaccaauuccagauucccugugccuauagaugaacucuacacuagccccaaugagaguuuggugguacaaccucagaacgggagaugcgcgcuggauggggaguugcaggguacuacucagcuccuccccacggcgaucugcucguucaggggucggauuaaucagaaagugaguggagagaaccauguuuggaauaugcaaaucaccaacauuaacggaaccccuuuugauccaacagaggauguuccagcuccucuagguacaccagacuuuucuggcaagcucuuuggcguccuaagccagagggaccaugauaaugccuguaggagccaugaugcagugauugcaacuaauucugcuaaauuuaccccaaaauugggcgcuauacaaauuggcacaugggaacaagaugauguacacaucaaccaacccaccaaauuuacuccaguuggcuuguuugaaagugaagguuuuaaucaguggacacucccuaauuauucuggagccuuaacacucaacaugggguuggcccccccuguggcccccacauuuccuggcgagcaaauucuuuucuucagaucccacauuccucuuaaaggagguguggcagacccaguuauugauugucucuugccccaagaguggauccaacaccuuuaucaggagucagccccuucacaaacagauguagcacugaucagauucacaaauccagacacagggcguguccuauuugaagcaaaauugcacaggaguggcuacaucacaguggccaacacugguagcagaccaauuguggugccagcuaaugguuacuucagguuugacucuuggguuaaucaguuuuauucucucgcccccaugggaacugggaaugggcgcagaagggugcaguaa

SEQ ID NO: 5208 - RNA, 1608 nt, Artificial Sequence
  VP1__Norovirus__AGT39197
augaagauggcgucgaaugacgccgcuccaucuaaugauggugcagccggucucguaccagaggucaacaaugagaccauggcacuugaaccgguggcuggggcuucaauagccgccccacucaccggucaaaauaauguuauagaccccuggauuagauuaaacuuugugcaagcucccaauggagaguuuacaguuucaccccgcaauucgccuggggaaguccuacuaaacuuggaauuaggcccugaacuaaauccauauuuggcacaccuuuccagaauguacaaugguuaugcagguggaguugaggugcaaguacuacuggcugggaacgcguucacggcuggaaaacugguauucgccgcaguucccccucauuuuccauuagaaaacauaagcccuggccaaauaaccauguucccucauguaauuauugauguuaggacuuuagaaccaguccuauugccucuuccagauguuaggaacaauuucuuucacuacaaucagcaaaacgaaccgaggaugaggcuuguggcaaugcucuauaccccccuuaggucuaaugguucuggugaugauguauuuacugucuccugcagagugcuuacucgacccucuccugauuuugauuucaauuauuugguacccccuacaguugaaucuaaaacuaaacccuucacacuccccaucuugaccauaggggaguuaaccaauuccagauucccugugccuauagaugaacucuacacuagccccaaugagaguuuggugguacaaccucagaacgggagaugcgcgcuggauggggaguugcaggguacuacucagcuccuccccacggcgaucugcucguucaggggucggauuaaucagaaagugaguggagagaaccauguuuggaauaugcaagucaccaacauuaacggaaccccuuuugauccaacagaggauguuccagcuccucuagguacaccagacuuuucuggcaagcucuuugguguccuaagccagagggaccaugauaaugccuguaggagccaugaugcagugauugcaacuaauucugcuaaauuuaccccaaaauugggcgcuauacaaauuggcacaugggaagaaaaugauguacacaucaaccaacccaccaaauuuacuccaguuggcuuguuugaaagugaagguuuuaaucaguggacacucccuaauuauucuggagccuuaacacucaacaugggguuggcccccccuguggcccccacauuuccuggcgagcaaauucuuuucuucagaucccacauuccucuuaaaggagguguggcagacccaguuauugauugucucuugccccaagaguggauccaacaccuuuaucaggagucagccccuucacaaacagauguagcacugaucagauucacaaauccagacacagggcguguccuauuugaagcaaaauugcacaggaguggcuacaucacaguggccaacacugguagcagaccaauuguggugccagcuaaugguuacuucagguuugacucuuggguuaaucaguuuuauucucucgcccccaugggaacugggaaugggcgcagaagggugcaguaa

SEQ ID NO: 5209 - RNA, 1608 nt, Artificial Sequence
  VP1__Norovirus__AGT39200
augaagauggcgucgaaugacgccgcuccaucuaaugauggugcagccggucucguaccagaggucaacaaugagaccauggcacuugaaccgguggcuggggcuucaauagccgccccacucaccggucaaaauaauguuauagaccccuggauuagauuaaacuuugugcaagcucccaauggagaguuuacaguuucaccccgcaauucgccuggggaaguccuacuaaacuuggaauuaggcccugaacuaaauccauauuuggcacaccuuuccagaauguacaaugguuaugcagguggaguugaggugcaaguacuacuggcugggaacgcguucacggcuggaaaacugguauucgccgcaguucccccucauuuuccauuagaaaacauaagcccuggccaaauaaccauguucccucauguaauuauugauguuaggacuuuagaaccaguccuauugccucuuccagauguuaggaacaauuucuuccacuacaaucagcaaaacgaaccgaggaugaggcuuguggcaaugcucuauaccccccuuaggucuaaugguucuggugaugauguauuuacugucuccuguagagugcuuacucgacccucuccugauuuugauuucaauuauuugguacccccuacaguugaaucuaaaacuaaacccuucacacuccccaucuuaaccauaggggaguuaaccaauuccagauucccugugccuauagaugaacucuacacuagccccaaugagaguuuggugguacaaccccagaacgggagaugcgcgcuggauggggaguugcaggguacuacucagcuccuccccacggcgaucugcucguucaggggucggauuaaucagaaagugaguggagagaaccauguuuggaauaugcaaaucaccaacauuaacggaaccccuuuugguccaacagaggauguuccagcuccucuagguacaccagacuuuucuggcaagcucuuuggcguccuaagccagagggaccaugauaaugccuguaggagccaugaugcagugauugcaacuaauucugcuaaauuuaccccaaaauugggcgcuauacaaauuggcacaugggaacaagaugauguacacaucaaccaacccaccaaauuuacuccaguuggcuuguuugaaagugaagguuuuaaucaguggacacucccuaauuauucuggagccuuaacacucaacaugggguuggcccccccuguggcccccacauuuccuggcgagcaaauucuuuucuacagaucccacauuccucuuaaaggagguguggcagacccaguuauugauugucucuugccccaagaguggauccaacaccuuuaucaggagucagccccuucacaaacagauguagcacugaucagauucacaaauccagacacagggcguguccuauuugaagcaaaauugcacaggaguggcuacaucacaguggccaacacugguagcagaccaauuguggugccagcuaaugguuacuucagauuugacucuuggguuaaucaguuuuauucucucgcccccaugggaacugggaaugggcgcagaagggugcaguaa

SEQ ID NO: 5210 - RNA, 1608 nt, Artificial Sequence
  VP1__Norovirus__AGT39203
augaagauggcgucgaaugacgccgcuccaucuaaugauggugcagccggucucguaccagaggucaacaaugagaccauggcacuugaaccgguggcuggggcuucaauagccgccccacucaccggucaaaauaauguuauagaccccuggauuagauuaaacuuugugcaagcucccaauggagaguuuacaguuucaccccgcaauucgccuggggaaguccuacuaaacuuggaauuaggcccugaacuaaauccauauuuggcacaccuuuccagaauguacaaugguuaugcagguggaguugaggugcaaguacuacuggcugggaacgcguucacggcuggaaaacugguauucgccgcaguucccccucauuuuccauuagaaaacauaagcccuggccaaauaaccauguucccucauguaauuauugauguuaggacuuuagaaccaguccuauugccucuuccagauguuaggaacaauuucuuucacuacaaucagcaaaacgaaccgaggaugaggcuuguggcaaugcucuauaccccccuuaggucuaaugguucuggugaugauguauuuacugucuccuguagagugcuuacucgacccucuccugauuuugauuucaauuauuugguacccccuacaguugaaucuaaaacuaaacccuucacacuccccaucuugaccauaggggaguuaaccaauuccagauucccugugccuauagaugaacucuacacuagccccaaugagaguuuggugguacaaccccagaacgggagaugcgcgcuggauggggaguugcaggguacuacucagcuccuccccacggcgaucugcucguucaggggucggauuaaucagaaagugaguggagagaaccauguuuggaauaugcaagucaccaacauuaacggaaccccuuuugauccaacagaggauguuccagcuccucuagguacaccagacuuuucuggcaagcucuuuggcguccuaagccagagggaccaugauaaugccuguaggagccaugaugcagugauugcaacuaauucugcuaaauuuaccccaaaauugggcgcuauacaaauuggcacaugggaacaagaugauguacacaucaaccaacccaccaaauuuacuccaguuggcuuguuugaaagugaagguuuuaaucaguggacacucccuaauuauucuggagccuuaacacucaacaugggguuggcccccccuguggcccccacauuuccuggcgagcaaauucuuuucuucagaucccacauuccucuuaaaggagguguggcagacccaguuauugauugucucuugccccaagaguggauccaacaccuuuaucaggagucagccccuucacaaacagauguagcacugaucagauucacaaauccagacacagggcguguccuauuugaagcaaaauugcacaggaguggcuacaucacaguggccaacacugguagcagaccaauuguggugccagcuaaugguuacuucagguuugacucuuggguuaaucaguuuuauucucuugcccccaugggaacugggaaugggcgcagaagggugcaguaa

SEQ ID NO: 5211 - RNA, 1629 nt, Artificial Sequence
  VP1__Norovirus__AGT39206
augaagauggcgucgaaugacgccgcuccaucuacugauggugcagccggccucgugccagaaaguaauaaugaggucauggcucuugaacccguggcuggugccgccuuggcagccccagucaccggucaaacaaauauaauagacccuuggauuagagcaaauuuuguccaggcccccaauggugaauuuacagucucuccccguaacuccccuggugaagugcuauugaaucuagaguuggguccagaauuaaauccuuaucuggcacauuuagcaagaauguacaauggguaugccggugggauggaggugcaggucauguuggcugggaacgcguucacagccggcaaguuagucuucgccgcugugccaccccacuucccggucgaaaaccuuagcccacagcaaauuaccauguucccucaugugauuauagaugucaggacuuuggaaccuguuuuauuaccacucccugauguuaggaauaacuucuuccauuauaaucagaaagaugaucccaagaugagaauuguggcuaugcuuuauaccccccuuaggucuaaugguucaggcgaugauguguuuacagucuccugcaggguguugacuagacccuccccugauuuugauuucacauaucuggugccaccaacaguggaaucuaaaacaaaaccauucacucucccaauccucacgcuuggggaacuuuccaauucuagauucccaguguccauagaccagauguacaccagccccaaugaagucauaucagugcagugucaaaacggcaggugcacacuggauggggaacuccaaggaacaacacaacuccaagucaguggcauuugugcuuucaagggagaagugacugcccacuugcaugacaaugaucaccuguauaaugucaccaucacaaacuugaauggguccccuuuugaccccuccgaggacauccccgccccucugggcguaccugacuuucagggaagggucuuuggugucaucucccaaagagacaaacacaauaccccuggacauaaugaaccagcaaacagggcacacgaugccguggucccuacuuauacagcacaguauaccccaaaauugggucagauucaaauuggcacauggcagacugacgaucucacagucaaccaaccagucaaauucaccccaguuggacuuaaugacacugaccauuuuaaccaauggguggucccaagguaugcuggugcccuaaaccuuaacacaaaccuugccccuucuguugcuccaguauuuccaggggagcgucugcucuuuuucagaucauacaucccccucaagggugguuauggaacuccagccaucgauugccuacuaccacaagagugggugcaacauuucuaucaggaagcagccccuucgaugagugagguggcccuugucagauacaucaacccggauacuggucgggcacuguuugaggccaaacuccacagagcugguuucaugacagucucaagcaacaccagugccccggugguugugccugccaacggauacuucagguuugauucuugggugaaccaauucuauucucucgcccccaugggaacuggaaaugggcgcagaaggauccaauaa

SEQ ID NO: 5212 - RNA, 1623 nt, Artificial Sequence
  VP1__Norovirus__AHF45991
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccauuuggccagaauguauaauaguuaugcaggugguuuugaagugcagguaauccucgcggggaacgcguucaccgccggaaaaaucauauuugcagcagucccaccaaauuucccaacugaaggcuugagccccagccaggucacuauguucccccauauaauaguagauguuaggcaacuggaaccuguguugaucccuuuacccgauguuaggaauaauuucuaucacuacaaucaaucaaacgaccccaccaucaaauugauagcaauguuguauacaccacuuagggcuaauaaugcuggggacgaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccagcagcgccuuuguuguucaaccacaaaauggcaggugcacgacugauggcgugcucuuagguacuacccaacugucuccugucaacaucugcaccuucagaggggaugucacccacauugcuaguacucaagaauacacaaugaaucuggccucccaaaacuggaacaauuaugacccaacagaagaaaucccagccccucugggaacuccagauuucguggguaagauccaaggcgugcucacccaaaccacaaggagggauggcucgacccgcggucacaaagccacagugagcacuggaaguguccacuucaccccaaagcugggcagaauucaauucuccacugauacaagcaaugauuuugaaacuggccaaaacacgagauucaccccagucgguguuguccaggaugguaguaccacccaccaaaaugaaccccaacaauggguacucccaaauuauucagguagagauagucacaaugugcaccuagccccugccguggcccccucuuuuccgggugagcaacuucuuuucuucagguccacuaugcccggaugcagcggguaucccaacaugaauuuggauugucuacucccccaggagugggugcagcacuucuaccaagaggcagccccagcacaaucugacguggcucugcuaagauuugugaauccagacacagguaggguuuuguuugaguguaagcuucauaaaucaggcuaugucacaguggcucacacuggccaacaugauuuaguuaucccccccaauggcuauuuuagauuugauuccugggucaaccaguucuacacacuugcccccaugggaaaugggacggggcguagacgugcauuauaa

SEQ ID NO: 5213 - RNA, 1623 nt, Artificial Sequence
  VP1__Norovirus__AHF45993
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgccccuaggcccugacuugaaucccuaccuuucccauuuggccagaauguacaaugguuaugcaggugguuuugaagugcagguaauccucgcggggaacgcguucaccgccgggaaaaucauauuugcagcagucccaccaaauuucccgacugaagguuugagccccagccaggucacuauguucccccacauaauaguagauguuaggcaauuggaaccuguguugauucccuuacccgauguuaggaauaauuucuaccauuauaaucaaucaaaugacuccaccaucaaauugauagcaauguuguauacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggaugucacccauauuccaggcagucguaacuacacaaugaauuuggccucccaaaauuggaacaguuacgauccaacagaagaaaucccagccccuuuaggaacuccagauuucguggggaagauucaaggugugcucacccaaaccacaaggacaaauggcucgacccgcggccacaaagcuacaguguauacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucacaaugugcaccuggcccccgcuguagcccccacuuucccgggcgagcagcuccucuucuucagaucuacuaugcccggaugcagcggguaucccaacauggacuuggacugucugcucccccaggaaugggugcaguauuucuaccaggaggcagccccagcacaaucugauguggcccugcuaagauuugugaauccggacacagguaggguuuuguuugaguguaagcuucauaaaucaggcuauguuacaguggcucauacuggccaacaugauuugguuaucccccccaaugguuacuuuagauuugauuccugggucaaccaguucuacacacuugcccccaugggaaaugggacggggcguagacgcgcauuguaa

SEQ ID NO: 5214 - RNA, 1623 nt, Artificial Sequence
  VP1__Norovirus__AHF45997
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuaggaacgcuccaggugaaauacuauggagcgcgcccuugggcccugaucugaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauuuucugucccaguuuuaacuguugaggagaugaccaauucaagauuccccaucccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcaguauaa

SEQ ID NO: 5215 - RNA, 1623 nt, Artificial Sequence
  VP1__Norovirus__AHF45999
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcaguauaa

SEQ ID NO: 5216 - RNA, 1623 nt, Artificial Sequence
  VP1__Norovirus__AHF46001
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccucuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuuugcuccaaaacuggguagaguucaauuugaaacugauacagaccaugauuuugaagcuaaccaaaacacaaaguucaccccaguuggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcaguauaa

SEQ ID NO: 5217 - RNA, 1617 nt, Artificial Sequence
  VP1__Norovirus__AHH44876
augaagauggcgucgaaugacgccaacccaucugauggguccgcagccaaccucgucccagaggucaacaaugagguuauggcuuuggagcccguuguuggugccgcuauugcggcgccuguggcgggccaacaaaauguaauugaccccuggauuagaaauaauuuuguacaagccccugguggagaguucacaauauccccuagaaaugcuccgggugaaauacuauggagugcacccuugggcccugauuuaaaccccuaccuuucucauuuggcuagaauguacaaugguuaugcagguggauuugaaguacaaguaguccucgcggggaaugcguucaccgccgggaaaaucauauuugcagcagucccaccaaauuuuccaacugaaggcuugagccccagccagguuacuauguucccccauauaauaguagauguuaggcaauuggaaccuguguugauucccuuacccgauguuaggaauaauuucuaucacuauaaccaaucaaaugauucuaccaucaaauugauagcaauguuguacacaccacuuagggcuaauaaugcuggggaugacgucuucacagucucuugucgaguccucacgaggccaucccccgauuuugauuucauauucuuagugccacccacaguugagucaagaaccaaaccauucaccgucccaguccuaacuguugaggaaaugaccaacucaagauuccccauuccucuggaaaagcuguucacgggacccagcagugcuuuuguuguccaaccacaaaauggcaggugcacgacugauggugugcucuugggcaccacccagcugucugcugucaacaucugcaccuucagaggggacgucacccacgucucagacaaaaccuuugcaaugaauuuggcuucuccaaauuggaacaauuaugacccaacagaagauaucccagccccccugggaacuccagauuucgugggaaggauccauggcaugcucacucaaaccacaaggagagauggcgcgacccgcggccacaaagccacagugagcacugggggugccgacuucacuccaaagcuggguaguguccgauacaucacugacacaaccgaugaucuugaaguccgugagaacacaaaauucaccccaaucggcguccuccacucuaguggugaacaccgagcugaacccgaucaauggagacucccagaauauucaggaagaaauguccacaaugugcaccuggcuccugccguugcccccaccuucccgggugagcaacuccucuucuucagauccgcucugcccggguguggcggguaccccaacacggaccuggacugccuacucccccaggagugggugcagcacuucuaccaggaagcagcgccagcacaaucugauguggcucugcugagguuugugaauccagacacagguaggguuuuguuugaaugcaagcuccauaaaucuggcuaugucacaguggcccacacuggcccgcaugauuugguuaucccccccaaugguuacuuuagauuugauuccugggucaaccaguucuacacacuugcccccaugggaaauggaacggggcguagacgugcauuauaa

SEQ ID NO: 5218 - RNA, 1617 nt, Artificial Sequence
  VP1__Norovirus__AHH44877
augaagauggcgucgaaugacgccaacccaucugauggguccgcagccaaccucgucccagaggucaacaaugagguuauggcuuuggagcccguuguuggugccgcuauugcggcgccuguggcgggccaacaaaauguaauugaccccuggauuagaaauaauuuuguacaagccccugguggagaguucacaauauccccuagaaaugcuccaggugaaauacuauggagugcacccuugggcccugauuuaaaccccuaccuuucucauuuggcuagaauguacaaugguuaugcagguggauuugaaguacaaguaguccucgcggggaaugcguucaccgccgggaaaaucauauuugcagcagucccaccaaauuuuccaacugaaggcuugagccccagccagguuacuauguucccccauauaauaguagauguuaggcaauuggaaccuguguugauucccuuacccgauguuaggaauaauuucuaucacuauaaccaaucaaaagauucuaccaucaaauugauagcaaugcuguacacaccacuuagggcuaauaaugcuggggaugaugucuucacagucucuugccgaguccucacgaggccaucccccgauuuugauuucauauucuuggugcccccuacaguugaaucaaggaccaaaccauucucugucccaguccuaacuguugaggaaaugaccaacucaagauuccccaucccccuggaaaaacuguucacaggacccagcagugcuuuuguuguccaaccacaaaauggcaggugcacgacugauggcgugcucuuaggcacuacccagcugucugcugucaacaucugcaccuucagaggggacgucacccacguugcaggugacaccuuugcaaugaauuuggcuucucuaaauuggaacaauuaugacccaacagaagaaaccccagccccucugggaacuccagauuucgugggaaggauccauggcaugcucacucaaaccacaagaagugauggcgcgacccgcgcccacaaagccacagugagcacugggggugccgacuucacuccaaagcugggcaguguccgauacagcacugacacauccggugaccuugaaguccgcgaaaacacaaaauucaccccaaucggcguccuccauuccaguggugaacgucgagcugaacccgaacaauggagacucccagaauauucaggaagaaauguucacaaugugcaucuggccccugccguugcccccaccuucccgggugagcaacuccucuucuucagauccacuaugcccggguguggcggguaccccaacauggaccuggacugccuacucccccaggagugggugcagcacuucuaccaggaagcagcgccugcacaaucugauguggcucugcugagguuugugaauccagacacagguaggguuuuguuugaaugcaagcuccauaaaucuggcuaugucacaguggcccacacuggcccgcaugauuugguuaucccccccaaugguuacuuuagauuugauuccugggucaaccaguucuacacacuugcccccaugggaaauggaacggggcguagacgugcauuauaa

SEQ ID NO: 5219 - RNA, 1617 nt, Artificial Sequence
  VP1__Norovirus__AHH44878
augaagauggcgucgagugacgccaacccaucugauggguccgcagccaaccucgucccagaggucaacaaugagguuauggcuuuggagcccguuguuggugccgcuauugcggcgccuguggcgggccaacaaaauguaauugaccccuggauuagaaauaauuuuguacaagccccugguggagaguucacaauauccccuagaaaugcuccaggugaaauacuauggagugcacccuugggcccugauuuaaaccccuaccuuucucauuuggcuagaauguacaaugguuaugcagguggauuugaaguacaaguaguccucgcggggaaugcguucaccgccgggaaaaucauauuugcagcagucccaccaaauuuuccaacugaaggcuugagccccagccaggucacuauguucccccauauaauaguagauguuaggcaauuggaaccuguguugauucccuuacccgauguuaggaauaauuucuaucacuauaaccaaucaaaagauucuaccaucaaauugauagcaaugcuguacacaccacuuagggcuaauaaugcuggggaugacgucuucacagucucuugucgaguccucacgaggccaucccccgauuuugauuucauauucuuggugcccccuacaguugaaucaaggaccaaaccauucucugucccaguccuaacuguugaggaaaugaccaacucaagauuccccaucccccuggaaaaacuguucacaggacccagcagugcuuuuguuguccaaccacaaaauggcaggugcacgacugauggcgugcucuuaggcacuacccagcugucugcugucaacaucugcaccuucagaggggacgucacccacguugcaggugacaccuuugcaaugaauuuggcuucucuaaauuggaacaauuaugacccaacagaagaaaccccagccccucugggaacuccagauuucgugggaaggauccauggcaugcucacucaaaccacaagaagugauggcgcgacccgcgcccacaaagccacagugagcacugggggugccgacuucacuccaaagcuggguaguguccgauacagcacugacacauccagugaucuugaaguccgcgaaaacacaaaauucaccccaaucggcguccuccauuccagugguggacaucgagcugaacccgaccaauggagacucccagaauauucaggaagaaauguucacaaugugcaucuggccccugccguugcccccaccuucccgggugagcaacuccucuucuucagauccacuaugcccggguguggcggguaccccaacauggaccuggacugccuacucccccaggagugggugcagcacuucuaccaggaagcagcgccagcacaaucugauguggcucugcugagguuugugaauccagacacagguaggguuuuguuugaaugcaagcuccauaaaucuggcuaugucacaguggcccacacuggcccgcaugauuugguuaucccccccaaugguuacuuuagauuugauuccugggucaaccaguucuacacacuugcccccaugggaaauggaacggggcguagacgugcauuauaa

SEQ ID NO: 5220 - RNA, 1617 nt, Artificial Sequence
  VP1__Norovirus__AHH44879
augaagauggcgucgaaugacgccaacccaucugauggguccgcagccaaccucgucccagaggucaacaaugagguuauggcuuuggagcccguuguuggugccgcuauugcggcgccuguggcgggccaacaaaauguaauugaccccuggauuagaaauaauuuuguacaagccccugguggagaguucacaauauccccuagaaaugcuccaggugaaauacuauggagugcacccuugggcccugauuuaaaccccuaccuuucucauuuggcuagaauguacaaugguuaugcagguggauuugaaguacaaguaguccucgcggggaaugcguucaccgccgggaaaaucauauuugcagcagucccaccaaauuuuccaacugaaggcuugagccccagccaggucacuauguucccccauauaauaguagauguuaggcaauuggaaccuguguugauucccuuacccgauguuaggaauaauuucuaucacuauaaccaaucaaaagauucuaccaucaaauugauagcaaugcuguacacaccacuuagggcuaauaaugcuggggaugacgucuucacagucucuugucgaguccucacgaggccaucccccgauuuugauuucauauucuuggugcccccuacaguugaaucaaggaccaaaccauucucugucccaguccuaacuguugaggaaaugaccaacucaagauuccccaucccccuggaaaaacuguucacaggacccagcagugcuuuuguuguccaaccacaaaauggcaggugcacgacugauggcgugcucuuaggcacuacccagcugucugcugucaacaucugcaccuucagaggggacgucacccacguugcaggugacaccuuugcaaugaauuuggcuucucuaaauuggaacaauuaugacccaacagaagaaaccccagccccucugggaacuccagauuucgugggaaggauccauggcaugcucacucaaaccacaagaagugauggcgcgacccgcgcccacaaagccacagugagcacugggggugccgacuucacuccaaagcuggguaguguccgauacagcacugacacauccagugaucuugaaguccgcgaaaacacaaaauucaccccaaucggcguccuccauuccagugguggacaucgagcugaacccgaccaauggagacucccagaauauucaggaagaaauguucacaaugugcaucuggccccugccguugcccccaccuucccgggugagcaacuccucuucuucagauccacuaugcccggguguggcggguaccccaacauggaccuggacugccuacucccccaggagugggugcagcacuucuaccaggaagcagcgccagcacaaucugauguggcucugcugagguuugugaauccagacacagguaggguuuuguuugaaugcaagcuccauaaaucuggcuaugucacaguggcccacacuggcccgcaugauuugguuaucccccccaaugguuacuuuagauuugauuccugggucaaccaguucuacacacuugcccccaugggaaauggaacggggcguagacgugcauuauaa

SEQ ID NO: 5221 - RNA, 1617 nt, Artificial Sequence
  VP1__Norovirus__AHH44880
augaagauggcgucgaaugacgccaacccaucugauggguccgcagccaaccucgucccagaggucaacaaugagguuauggcuuuggagcccguuguuggugccgcuauugcggcgccuguggcgggccaacaaaauguaauugaccccuggauuagaaauaauuuuguacaagccccugguggagaguucacaauauccccuagaaaugcuccaggugaaauacuauggagugcacccuugggcccugauuuaaaccccuaccuuucucauuuggcuagaauguacaaugguuaugcagguggauuugaaguacaaguaguccucgcggggaaugcguucaccgccgggaaaaucauauuugcagcagucccaccaaauuuuccaacugaaggcuugagccccagccagguuacuauguucccccauauaauaguagauguuaggcaauuggaaccuguguugauucccuuacccgauguuaggaacaauuucuaucacuauaaccaaucaaaagauucuaccaucaaauugauagcaaugcuguacacaccacuuagggcuaauaaugcuggggaugacgucuucacagucucuugucgaguccucacgaggccaucccccgauuuugauuucauauucuuggugcccccuacaguugaaucaaggaccaaaccauucucugucccaguccuaacuguugaggaaaugaccaacucaagauuccccaucccccuggaaaaacuguucacaggacccagcagugcuuuuguuguccaaccacaaaauggcaggugcacgacugauggcgugcucuuaggcacuacccagcugucugcugucaacaucugcaccuucagaggggacgucacccacguugcaggugacaccuuugcaaugaauuuggcuucucuaaauuggaacaauuaugacccaacagaagaaaccccagccccucugggaacuccagauuucgugggaaggauccauggcaugcucacucaaaccacaagaagugauggcgcgacccgcgcccacaaagccacagugagcacugggggugccgacuucacuccaaagcuggguaguguccgauacagcacugacacauccagugaucuugaaguccgcgaaaacacaaaauucaccccaaucggcguccuccauuccagugguggacaucgagcugaacccgaccaauggagacucccagaauauucaggaagaaauguucacaaugugcaucuggccccugccguugcccccaccuucccgggugagcaacuccucuucuucagauccacuaugcccggguguggcggguaccccaacauggaccuggacugccuacucccccaggagugggugcagcacuucuaccaggaaacagcgccagcacaaucugauguggcucugcugagguuugugaauccagacacagguaggguuuuguuugaaugcaagcuccauaaaucuggcuaugucacaguggcccacacuggcccgcaugauuugguuaucccccccaaugguuacuuuagauuugauuccugggucaaccaguucuacacacuugcccccaugggaaauggaacggggcguagacgugcauuauaa

SEQ ID NO: 5222 - RNA, 1617 nt, Artificial Sequence
  VP1__Norovirus__AHH44881
augaagauggcgucgaaugacgccaacccaucugauggguccgcagccaaccucgucccagaggucaacaaugagguuauggcucuggagcccguuguuggcgccgcuauugcggcgccuguggcgggccaacaaaauguaauugaccccuggauuagaaauaauuuuguacaagccccugguggagaguuuacaauauccccuagaaacgcuccaggugagauacuauggagcgcgcccuugggcccugauuuaaaccccuaccuuucucauuuggcuagaauguauaaugguuaugcagguggauuugaaguacaaguaguccucgcggggaacgcguucaccgccgggaaagucauauuugcagcagucccaccaaauuuuccaacugagggcuugagccccagccagguuacuauguuuccccauauaauaguagauguuaggcaauuggaaccuguguugauucccuuacccgauguuaggaauaauuucuaucacuauaaccaaucaaaugauucuaccaucaaauugauagcaaugcuguacacaccacuuagggcuaauaaugcuggggaugaugucuucacagucucuugccgaguccucacgaggccaucccccgauuuugauuucauauucuuggugcccccuacaguugaaucaaggaccaaaccauucucugucccaguccuaacuguugaggaaaugaccaacucaagauuccccaucccccuggaaaaacuguucacaggacccagcagugcuuuuguuguccaaccacaaaauggcaggugcacgacugauggcgugcucuuaggcacuacccagcugucugcugucaacaucugcaccuucagaggggacgucacccacguugcaggugacaccuuugcaaugaauuuggcuucucuaaauuggaacaauuaugacccaacagaagaaaccccagccccucugggaacuccagauuucgugggaaggauccauggcaugcucacucaaaccacaagaagugauggcgcgacccgcgcccacaaagccacagugagcacugggggugccgacuucacuccaaagcuggguaguguccgauacagcacugacacauccagugaccuugaaguccgcgaaaacacaaaauucaccccaaucggcguccuccauuccagugguggacaucgagcugaacccgaccaauggagacucccagaauauucaggaagaaauguucacaaugugcaucuggccccugccguugcccccaccuucccgggugagcaacuccucuucuucagauccacuaugcccggguguggcggguaccccaacauggaccuggacugccuacucccccaggagugggugcagcacuucuaccaggaagcagcgccagcacaauccgauguggcucugcugagguuugugaauccagacacagguaggguuuuguuugaaugcaagcuccauaaaucuggcuaugucacaguggcccacacuggcccgcaugauuugguuaucccccccaaugguuacuuuagauuugauuccugggucaaccaguucuacacacuugcccccaugggaaauggaacggggcguagacgugcauuauaa

SEQ ID NO: 5223 - RNA, 1617 nt, Artificial Sequence
  VP1__Norovirus__AHH44884
augaagauggcgucgaaugacgccaacccaucugauggguccgcagccaaccucgucccagaggucaacaaugagguuauggcuuuggagcccguuguuggugccgcuauugcggcgccuguggcgggccaacaaaauguaauugaccccuggauuagaaauaauuuuguacaagccccugguggagaguucacaauauccccuagaaaugcuccaggugaaauacuauggagugcacccuuggguccugauuuaaaccccuaccuuucucauuuggcuagaauguacaaugguuaugcagguggauuugaaguacaaguaguccucgcggggaaugcguucaccgccgggaaaaucauauuugcagcagucccaccaaauuuuccaacugaaggcuugagccccagccagguuacuauguucccccauauaauaguagauguuaggcaauuggaaccuguguugauucccuuacccgauguuaggaauaauuucuaucacuauaaccaaucaaaugauucuaucaucaaauugauagcaauguuguacacaccacuuagggcuaauaaugcuggggaugacgucuucacagucucuugucgaguccucacgaggccaucccccgauuuugauuucauauucuuagugccacccacaguugagucaagaaccaaaccauucaccgucccaguccuaacuguugaugaaaugaccaacucaagauuccccauuccucuggaaaagcuguucacgggacccagcagugcuuuuguuguccaaccacaaaauggcaggugcacgacugauggugugcucuugggcaccacccagcugucugcugucaacaucugcaccuucagaggggacgucacccacguuucagacaaaaccuuugcaaugaauuuggcuucuccaaauuggaacaauuaugacccaacagaagaaaucccagccccccugggaacuccagauuucgugggaaggauccauggcaugcucacucaaaccacaaggagagauggcgcgacccgcggccacaaagccacagugagcacugggggugccgacuucacuccaaagcuggguaguguccgauacaucacugacacaaccgaugaucuugaaguccgugagaacacaaaauucaccccaaucgguguccuccacuccaguggugaacaccgagcugaacccgaucaauggagacucccagaauauucaggaagaaauguccacaaugugcaccuggcuccugccguugcccccaccuucccgggugagcaacuccucuucuucagauccgcucugcccggguguggcggguaccccaacacggaccuggacugccuacucccccaggaaugggugcagcacuucuaccaggaagcagcgccagcacaaucugacguggcucugcugagguuuguaaauccagacacagguaggguuuuauuugaaugcaagcuccauaaaucugguuaugucacaguggcccacacuggcccgcaugauuugguuaucccccccaaugguuacuuuagauuugauuccugggucaaccaguucuacacacuugcccccaugggaaauggaacggggcguagacgugcauuauaa

SEQ ID NO: 5224 - RNA, 1620 nt, Artificial Sequence
  VP1__Norovirus__AHH44886
augaagauggcgucgaaugacgccagcccaucugauggguccgcagccaaccucgucccagaggucaacaaugagguuauggcuuuggagcccguuguuggugccgcaauugcggcgccuguagcgggccaacaaaauguaauugaccccuggauuagaaauaauuuuguacaagccccugguggagaguucacaguguccccuagaaacgcuccaggggaaauacuauggagcgcacccuuaggcccugaucugaaucccuaccuuucccauuuggccaggauguacaaugguuaugcagguggcuuugaagugcagguaauccucgcggggaacgcguucaccgccgggaaaaucauauuugcagcagucccaccaaauuucccaacugaaggcuuaagucccagccaggucacuauguucccccauauaguaguagauguuagacaacuggaaccuguguugauccccuuacccgaugucaggaauaauuucuaccacuacaaccaaucaaaagaccccaccaucaaauugauagcaaugcuguacacaccacuuagggcuaauaaugcuggggaagaugucuucacagucucuugccgaguccucacgaggccaucccccgauuuugauuucauauucuuggugccacccacaguugagucaagaucaaaaccauucaccgucccaauucuaacuguugaggaaaugaccaauucaagguuccccauucccuuggaaaagcuguucacgggucccagcggugccuuuguuguccaaccacaaaauggcaggugcacgacugauggcgugcucuuaggcaccacccaacugucuccugucaacaucugcaccuucagaggggaucucacccacuuuacaggcaccuccgaauacgcaaugaauuuggcuucucaaaauuggaauaauuaugacccaacagaagaaaucccagccccucugggagccccagauuuugugggaaagauccgagguaugcucacucaaaccacaaggagggacgguucgacccgcggccacagggcuacauugagcacugggagcgcccacuucacuccaaagcugggcagcauucgguuuuccacugauacaaacaaugauuuugaagcuggccaaaacacgaaauucaccccagucggugucuuccaggaaggcgacaaccaccaaaaugaaccccaacaaugggugcucccaaauuauucaggugcaacugcccacaauguacaccuugccccugccguggcccccgcuuuuccgggugagcaacugcucuucuucagguccaccaugcccggauguggcggguaucccaacaugaauuuggauugucuacucccacaggaaugggugcagcacuucuaucaagaggcagccccagcacaaucugacguggcucugcuaagauuugugaauccagauacaaguaggguuuuguuugagugcaagcuccauaaaucagguuaugucacaguggcccacacuggccagcaugauuugguuauccccccuaauggcuacuuuagauuugauuccugggucaaccaauucuacacacuugcccccaugggaaauggaacggggcguagacgugcauuauaa

SEQ ID NO: 5225 - RNA, 1620 nt, Artificial Sequence
  VP1__Norovirus__AHH44888
augaagauggcgucgaaugacgccagcccaucugauggguccgcagccaaccucgucccagaggucaacaaugagguuauggcuuuggagcccguuguuggugccgcaauugcggcgccuguagcgggccaacaaaauguaauugaccccuggauuagaaauaauuuuguacaagccccugguggagaguucacaguguccccuagaaacgcuccaggugaaauacuauggagcgcacccuuaggcccugaucugaaucccuaccuuucccauuuggccaggauguacaaugguuaugcagguggcuuugaagugcagguaauccucgcggggaacgcguucaccgccgggaaaaucauauuugcagcagucccaccaaauuucccaacugaaggcuuaagucccagccaggucacuauguucccccauauaguaguagauguuagacaacuggaaccuguguugauccccuuacccgaugucaggaauaauuucuaccacuacaaccaaucaaaagaccccaccaucaaauugauagcaaugcuguacacaccacuuagggcuaauaaugcuggggaagaugucuucacagucucuugccgaguccucacgaggccaucccccgauuuugauuucauauucuuggugccacccacaguugagucaagaucaaaaccauucaccgucccaauucuaacuguugaggaaaugaccaauucaagguuccccauucccuuggaaaagcuguucacgggucccagcggugccuuuguuguccaaccacaaaauggcaggugcacgacugauggcgugcucuuaggcaccacccaacugucuccugucaacaucugcaccuucagaggggaucucacccacuuuacaggcaccuccgaauacgcaaugaauuuggcuucucaaaauuggaauaauuaugacccaacagaagaaaucccagccccucugggagccccagauuuugugggaaagauccgagguaugcucacucaaaccacaaggagggacgguucgacccgcggccacagggcuacauugagcacugggagcgcccacuucacuccaaagcugggcaacauucgguuuuccacugauacaaacaaugauuuugaagcuggccaaaacacgaaauucaccccagucggugucuuccaggaaggcgacaaccaccaaaaugaaccccaacaaugggugcucccaaauuauucaggugcaacugcccacaauguacaccuugccccugccguggcccccgcuuuuccgggugagcaacugcucuucuucagguccaccaugcccggauguggcggguaucccaacaugaauuuggauugucuacucccacaggaaugggugcagcacuucuaucaagaggcagccccagcacaaucugacguggcucugcuaagauuugugaauccagauacaaguaggguuuuguuugagugcaagcuccauaaaucagguuaugucacaguggcccauacuggccagcaugauuugguuauccccccuaauggcuacuuuagauuugauuccugggucaaccaauucuacacacuugcccccaugggaaauggaacggggcguagacgugcauuauaa

SEQ ID NO: 5226 - RNA, 1620 nt, Artificial Sequence
  VP1__Norovirus__AHH44889
augaagauggcgucgaaugacgccagcccaucugauggguccgcagccaaccucgucccagaggucagcaaugagguuauggcuuuggagcccguuguuggugccgcaauugcggcgccuguagcgggccaacaaaauguaauugaccccuggauuagaaauaauuuuguacaagccccugguggagaguucacaguguccccuagaaacgcuccaggugaaauacuauggagcgcacccuuaggcccugaucugaaucccuaccuuucccauuuggccaggauguacaaugguuaugcagguggcuuugaagugcagguaauccucgcggggaacgcguucaccgccgggaaaaucauauuugcagcagucccaccaaauuucccaacugaaggcuuaagucccagccaggucacuauguucccccauauaguaguagauguuagacaacuggaaccuguguugauucccuuacccgaugucaggaauaauuucuaccacuacaaccaaucaaaagaccccaccaucaaauugauagcaaugcuguacacaccacuuagggcuaauaaugcuggggaagaugucuucacagucucuugccgaguccucacgaggccaucccccgauuuugauuucauauucuuggugccacccacaguugagucaagaucaaaaccauucaccgucccaauucuaacuguugaggaaaugaccaauucaagguuccccauucccuuggaaaagcuguucacgggucccagcggugccuuuguuguccaaccacaaaauggcaggugcacgacugauggcgugcucuuaggcaccacccaacugucuccugucaacaucugcaccuucagaggggaucucacccacuuuacaggcaccuccgaauacgcaaugaauuuggcuucucaaaauuggaauaauuaugacccaacagaagaaaucccagccccucugggagccccagauuucgugggaaagauccgagguaugcucacucaaaccacaaggagggacgguucgacccgcggccacagggcuacauugagcacugggagcgcccacuucacuccaaagcugggcagcauucgguuuuccacugauacaaacaaugauuuugaagcuggccaaaacacgaaauucaccccagucgguaucuuccaggaaggcgacaaccaccaaaaugaaccccaacaaugggugcucccaaauuauucaggugcaacugcccacaauguacaccuugccccugccguggcccccgcuuuuccgggugagcaacugcucuucuucagguccaccaugcccggauguggcggguaucccaacaugaauuuggauugucuacucccacaggaaugggugcagcacuucuaucaagaggcagccccagcacaaucugacguggcucugcuaagauuugugaauccagauacaaguaggguuuuguuugagugcaagcuccauaaaucagguuaugucacaguggcccauacuggccagcaugauuugguuauccccccuaauggcuacuuuagauuugauuccugggucaaccaauucuacacacuugcccccaugggaaauggaacggggcguagacgugcauuauaa

SEQ ID NO: 5227 - RNA, 1620 nt, Artificial Sequence
  VP1__Norovirus__AHH44890
augaagauggcgucgaaugacgccagcccaucugauggguccgcagccaaccucgucccagaggucaacaaugagguuauggcuuuggagcccguuguuggugccgcaauugcggcgccuguagcgggccaacaaaauguaauugaccccuggauuagaaauaauuuuguacaagccccugguggagaguucacaguguccccuagaaacgcuccaggugaaauacuauggagcgcacccuuaggcccugaucugaaucccuaccuuucccauuuggccaggauguacaaugguuaugcagguggcuuugaagugcagguaauccucgcggggaacgcguucaccgccgggaaaaucauauuugcagcagucccaccaaauuucccaacugaaggcuuaagucccagccaggucacuauguucccccauauaguaguagauguuagacaacuggaaccuguguugauccccuuacccgaugucaggaauaauuucuaccacuacaaccaaucaaaagaccccaccaucaaauugauagcaaugcuguacacaccacuuagggcuaauaaugcuggggaagaugucuucacagucucuugccgaguccucacgaggccaucccccgauuuugauuucauauucuuggugccacccacaguugagucaagaucaaaaccauucaccgucccaauucuaacuguugaggaaaugaccaauucaagguuccccauucccuuggaaaagcuguucacgggucccagcggugccuuuguuguccaaccacaaaauggcaggugcacgacugauggcgugcucuuaggcaccacccaacugucuccugucaacaucugcaccuucagaggggaucucacccacuuuacaggcaccuccgaauacgcaaugaauuuggcuucucaaaauuggaauaauuaugacccaacagaagaaaucccagccccucugggagccccagauuuugugggaaagauccgagguaugcucacucaaaccacaaggagggacgguucgacccgcggccacagggcuacauugagcacugggagcgcccacuucacuccaaagcugggcaacauucgguuuuccacugauacaaacaaugauuuugaggcuggccaaaacacgaaauucaccccagucggugucuuccaggaaggcgacaaccaccaaaaugaaccccaacaaugggugcucccaaauuauucaggugcaacugcccacaauguacaccuugccccugccguggcccccgcuuuuccgggugagcaacugcucuucuucagguccaccaugcccggauguggcggguaucccaacaugaauuuggauugucuacucccacaggaaugggugcagcacuucuaucaagaggcagccccagcacaaucugacguggcucugcuaagauuugugaauccagauacaaguaggguuuuguuugagugcaagcuccauaaaucagguuaugucacaguggcccauacuggccagcaugauuugguuauccccccuaauggcuacuuuagauuugauuccugggucaaccaauucuacacacuugcccccaugggaaauggaacggggcguagacgugcauuauaa

SEQ ID NO: 5228 - RNA, 1620 nt, Artificial Sequence
  VP1__Norovirus__AHH44891
augaagauggcgucgaaugacgccagcccaucugauggguccgcagccaaccucgucccagaggucaacaaugagguuauggcuuuggagcccguuguuggugccgcaauugcggcgccuguagcgggccaacaaaauguaauugaccccuggauuagaaauaauuuuguacaagccccugguggagaguucacaguguccccuagaaacgcuccaggugaaauacuauggagcgcacccuuaggcccugaucugaaucccuaccuuucccauuuggccaggauguacaaugguuaugcagguggcuuugaagugcagguaauccucgcggggaacgcguucaccgccgggaaaaucauauuugcagcagucccaccaaauuucccaacugaaggcuuaagucccagccaggucacuauguucccccauauaguaguagauguuagacaacuggaaccuguguugauccccuuacccgaugucaggaauaauuucuaccacuacaaccaaucaaaggaccccaccaucaaauugauagcaaugcuguacacaccacuuagggcuaauaaugcuggggaagaugucuucacagucucuugccgaguccucacgaggccaucccccgauuuugauuucauauucuuggugccacccacaguugagucaagaucaaaaccauucaccgucccaauucuaacuguugaggaaaugaccaauucaagguuccccauucccuuggaaaagcuguucacgggucccagcggugccuuuguuguccaaccacaaaauggcaggugcacgacugauggcgugcucuuaggcaccacccaacugucuccugucaacaucugcaccuucagaggggaucucacccacuuuacaggcaccuccgaauacgcaaugaauuuggcuucucaaaauuggaauaauuaugacccaacagaagaaaucccagccccucugggagccccagauuuugugggaaagauccgagguaugcucacucaaaccacaaggagggacgguucgacccgcggccacagggcuacauugagcacugggagcgcccacuucacuccaaagcugggcaacauucgguuuuccacugauacaaacaaugauuuugaagcuggccaaaacacgaaauucaccccagucggugucuuccaggaaggcgacaaccaccaaaaugaaccccaacaaugggugcucccaaauuauucaggugcaacugcccacaauguacaccuugccccugccguggcccccgcuuuuccgggugagcaacugcucuucuucagguccaccaugcccggauguggcggguaucccaacaugaauuuggauugucuacucccacaggaaugggugcagcacuucuaucaagaggcagccccagcacaaucugacguggcucugcuaagauuugugaauccagauacaaguaggguuuuguuugagugcaagcuccauaaaucagguuaugucacaguggcccauacuggccagcaugauuugguuauccccccuaauggcuacuuuagauuugauuccugggucaaccaauucuacacacuugcccccaugggaaauggaacggggcguagacgugcauuauaa

SEQ ID NO: 5229 - RNA, 1620 nt, Artificial Sequence; identical to SEQ ID NO: 5225
  VP1__Norovirus__AHH44893

SEQ ID NO: 5230 - RNA, 1620 nt, Artificial Sequence
  VP1__Norovirus__AHH44894
augaagauggcgucgaaugacgccagcccaucugauggguccgcagccaaccucgucccagaggucagcaaugagguuauggcuuuggagcccguuguuggugccgcaauugcggcgccuguagcgggccaacaaaauguaauugaccccuggauuagaaauaauuuuguacaagccccugguggagaguucacaguguccccuagaaacgcuccaggugaaauacuauggagcgcacccuuaggcccugaucugaaucccuaccuuucccauuuggccaggauguacaaugguuaugcagguggcuuugaagugcagguaauccucgcggggaacgcguucaccgccgggaaaaucauauuugcagcagucccaccaaauuucccaacugaaggcuuaagucccagccaggucacuauguucccccauauaguaguagauguuagacaacuggaaccuguguugauccccuuacccgaugucaggaauaauuucuaccacuacaaccaaucaaaagaccccaccaucaaauugauagcaaugcuguacacaccacuuagggcuaauaaugcuggggaagaugucuucacagucucuugccgaguccucacgaggccaucccccgauuuugauuucauauucuuggugccacccacaguugagucaagaucaaaaccauucaccgucccaauucuaacuguugaggaaaugaccaauucaagguuccccauucccuuggaaaagcuguucacgggucccagcggugccuuuguuguccaaccacaaaauggcaggugcacgacugauggcgugcucuuaggcaccacccaacugucuccugucaacaucugcaccuucagaggggaucucacccacuuuacaggcaccuccgaauacgcaaugaauuuggcuucucaaaauuggaauaauuaugacccaacagaagaaaucccagccccucugggagccccagauuucgugggaaagauccgagguaugcucacucaaaccacaaggagggacgguucgacccgcggccacagggcuacauugagcacugggagcgcccacuucacuccaaagcugggcagcauucgguuuuccacugauacaaacaaugauuuugaagcuagccaaaacacgaaauucaccccagucggugucuuccaggaaggcgacaaccaccaaaaugaaccccaacaaugggugcucccaaauuauucaggugcaacugcccacaauguacaccuugccccugccguggcccccgcuuuuccgggugagcaacugcucuucuucagguccaccaugcccggauguggcggguaucccaacaugaauuuggauugucuacucccacaggaaugggugcagcacuucuaucaagaggcagccccagcacaaucugacguggcucugcuaagauuugugaauccagauacaaguaggguuuuguuugagugcaagcuccauaaaucagguuaugucacaguggcccauacuggccagcaugauuugguuauccccccuaauggcuacuuuagauuugauuccugggucaaccaauucuacacacuugcccccaugggaaauggaacggggcguagacgugcauuauaa

SEQ ID NO: 5231 - RNA, 1620 nt, Artificial Sequence
  VP1__Norovirus__AHH44895
augaagauggcgucgaaugacgccagcccaucugauggguccgcagccaaccucgucccagaggucaacaaugagguuauggcuuuggagcccguuguuggugccgcaauugcggcgccuguagcgggccaacaaaauguaauugaccccuggauuagaaauaauuuuguacaagccccugguggagaguucacaguguccccuagaaacgcuccaggugaaauacuauggagcgcacccuuaggcccugaucugaaucccuaccuuucccauuuggccaggauguacaaugguuaugcagguggcuuugaagugcagguaauccucgcggggaacgcguucaccgccgggaaaaucauauuugcagcagucccaccaaauuucccaacugaaggcuuaagucccagccaggucacuauguucccccauauaguaguagauguuagacaacuggaaccuguguugauccccuuacccgaugucaggaauaauuucuaccacuacaaccaaucaaaagaccccaccaucaaauugauagcaaugcuguacacaccacuuagggcuaauaaugcuggggaagaugucuucacagucucuugccgaguccucacgaggccaucccccgauuuugauuucauauucuuggugccacccacaguugagucaagaucaaaaccauucaccgucccaauucuaacuguugaggaaaugaccaauucaagguuccccauucccuuggaaaagcuguucacgggucccagcggugccuuuguuguccaaccacaaaauggcaggugcacgacugauggcgugcucuuaggcaccacccaacugucuccugucaacaucugcaccuucagaggggaucucacccacuuuacaggcaccuccgaauacgcaaugaauuuggcuucucaaaauugggauaauuaugacccaacagaagaaaucccagccccucugggagccccagauuuugugggaaagauccgagguaugcucacucaaaccacaaggagggacgguucgacccgcggccacagggcuacauugagcacugggagcgcccacuucacuccaaagcugggcaacauucgguuuuccacugauacaaacaaugauuuugaagcuggccaaaacacgaaauucaccccagucggugucuuccaggaaggcgacaaccaccaaaaugaaccccaacaaugggugcucccaaauuauucaggugcaacugcccacaauguacaccuugccccugccguggcccccgcuuuuccgggugagcaacugcucuucuucagguccaccaugcccggauguggcggguaucccaacaugaauuuggauugucuacucccacaggaaugggugcagcacuucuaucaagaggcagccccagcacaaucugacguggcucugcuaagauuugugaauccagauacaaguaggguuuuguuugagugcaagcuccauaaaucagguuaugucacaguggcccauacuggccagcaugauuugguuauccccccuaauggcuacuuuagauuugauuccugggucaaccaauucuacacacuugcccccaugggaaauggaacggggcguagacgugcauuauaa

SEQ ID NO: 5232 - RNA, 1620 nt, Artificial Sequence; identical to SEQ ID NO: 5227
  VP1__Norovirus__AHH44896

SEQ ID NO: 5233 - RNA, 1620 nt, Artificial Sequence; identical to SEQ ID NO: 5227
  VP1__Norovirus__AHH44897

SEQ ID NO: 5234 - RNA, 1620 nt, Artificial Sequence; identical to SEQ ID NO: 5227
  VP1__Norovirus__AHH44899

SEQ ID NO: 5235 - RNA, 1620 nt, Artificial Sequence
  VP1__Norovirus__AHH44900
augaagauggcgucgaaugacgccagcccaucugauggguccgcagccaaccucgucccagaggucaacaaugagguuauggcuuuggagcccguuguuggugccacaauugcggcgccuguagcgggccaacaaaauguaauugaccccuggauuagaaauaauuuuguacaagccccugguggagaguucacaguguccccuagaaacgcuccaggugaaauacuauggagcgcacccuuaggcccugaucugaaucccuaccuuucccauuuggccaggauguacaaugguuaugcagguggcuuugaagugcagguaauccucgcggggaacgcguucaccgccgggaaaaucauauuugcagcagucccaccaaauuucccaacugaaggcuuaagucccagccaggucacuauguucccccauauaguaguagauguuagacaacuggaaccuguguugauccccuuacccgaugucaggaauaauuucuaccacuacaaccaaucaaaagaccccaccaucaaauugauagcaaugcuguacacaccacuuagggcuaauaaugcuggggaagaugucuucacagucucuugccgaguccucacgaggccaucccccgauuuugauuucauauucuuggugucacccacaguugagucaagaucaaaaccauucaccgucccaauucuaacuguugaggaaaugaccaauucaagguuccccauucccuuggaaaagcuguucacgggucccagcggugccuuuguuguccaaccacaaaauggcaggugcacgacugauggcgugcucuuaggcaccacccaacugucuccugucaacaucugcaccuucagaggggaucucacccacuuuacaggcaccuccgaauacgcaaugaauuuggcuucucaaaauuggaauaauuaugacccaacagaagaaaucccagccccucugggagccccagauuuugugggaaagauccgagguaugcucacucaaaccacaaggagggacgguucgacccgcggccacagggcuacauugagcacugggagcgcccacuucacuccaaagcugggcaacauucgguuuuccacugauacaaacaaugauuuugaggcuggccaaaacacgaaauucaccccagucggugucuuccaggaaggcgacaaccaccaaaaugaaccccaacaaugggugcucccaaauuauucaggugcaacugcccacaauguacaccuugccccugccguggcccccgcuuuuccgggugagcaacugcucuucuucagguccaccaugcccggauguggcggguaucccaacaugaauuuggauugucuacucccacaggaaugggugcagcacuucuaucaagaggcagccccagcacaaucugacguggcucugcuaagauuugugaauccagauacaaguaggguuuuguuugagugcaagcuccauaaaucagguuaugucacaguggcccauacuggccagcaugauuugguuauccccccuaauggcuacuuuagauuugauuccugggucaaccaauucuacacacuugcccccaugggaaauggaacggggcguagacgugcauuauaa

SEQ ID NO: 5236 - RNA, 1620 nt, Artificial Sequence; identical to SEQ ID NO: 5227
  VP1__Norovirus__AHH44902

SEQ ID NO: 5237 - RNA, 1620 nt, Artificial Sequence
  VP1__Norovirus__AHH44904
augaagauggcgucgaaugacgccagcccaucugauggguccgcagccaaccucgucccagaggucaacaaugagguuauggcuuuggagcccguuguuggugccgcaauugcggcgccuguagcgggccaacaaaauguaauugaccccuggauuagaaauaauuuuguacaagccccugguggagaguucacaguguccccuagaaacgcuccaggugaaauacuauggagcgcacccuuaggcccugaucugaaucccuaccuuucccauuuggccaggauguacaaugguuaugcagguggcuuugaagugcagguaauccucgcggggaacgcguucaccgccgggaaaaucauauuugcagcagucccaccaaauuucccaacugaaggcuuaagucccagccaggucacuauguucccccauauaguaguagauguuagacaacuggaaccuguguugauccccuuacccgaugucaggaauaauuucuaccacuacaaccaaucaaaagaccccaccaucaaauugauagcaaugcuguacacaccacuuagggcuaauaaugcuggggaagaugucuucacagucucuugccgaguccucacgaggccaucccccgauuuugauuucauauucuuggugucacccacaguugagucaagaucaaaaccauucaccgucccaauucuaacuguugaggaaaugaccaauucaagguuccccauucccuuggaaaagcuguucacgggucccagcggugccuuuguuguccaaccacaaaauggcaggugcacgacugauggcgugcucuuaggcaccacccaacugucuccugucaacaucugcaccuucagaggggaucucacccacuuuacaggcaccuccgaauacgcaaugaauuuggcuucucaaaauuggaauaauuaugacccaacagaagaaaucccagccccucugggagccccagauuuugugggaaagauccgagguaugcucacucaaaccacaaggagggacgguucgacccgcggccacagggcuacauugagcacugggagcgcccacuucacuccaaagcugggcaacauucgguuuuccacugauacaaacaaugauuuugaagcuggccaaaacacgaaauucaccccagucggugucuuccaggaaggcgacaaccaccaaaaugaaccccaacaaugggugcucccaaauuauucaggugcaacugcccacaauguacaccuugccccugccguggcccccgcuuuuccgggugagcaacugcucuucuucagguccaccaugcccggauguggcggguaucccaacaugaauuuggauugucuacucccacaggaaugggugcagcacuucuaucaagaggcagccccagcacaaucugacguggcucugcuaagauuugugaauccagauacaaguaggguuuuguuugagugcaagcuccauaaaucagguuaugucacaguggcccauacuggccagcaugauuugguuauccccccuaauggcuacuuuagauuugauuccugggucaaccaauucuacacacuugcccccaugggaaauggaacggggcguagacgugcauuauaa

SEQ ID NO: 5238 - RNA, 1620 nt, Artificial Sequence; identical to SEQ ID NO: 5227
  VP1__Norovirus__AHH44905

SEQ ID NO: 5239 - RNA, 1620 nt, Artificial Sequence
  VP1__Norovirus__AHH44906
augaagauggcgucgaaugacgccagcccaucugauggguccgcagccaaccucgucccagaggucaacaaugagguuauggcuuuggagcccguuguuggugccgcaauugcggcgccuguagcgggccaacaaaauguaauugaccccuggauuagaaauaauuuuguacaagccccugguggagaguucacaguguccccuagaaacgcuccaggugaaauacuauggagcgcacccuuaggcccugaucugaaucccuaccuuucccauuuggccaggauguacaaugguuaugcagguggcuuugaagugcagguaauccucgcggggaacgcguucaccgccgggaaaaucauauuugcagcagucccaccaaauuucccaacugaaggcuuaagucccagccaggucacuauguucccccauauaguaguagauguuagacaacuggaaccuguguugauccccuuacccgaugucaggaauaauuucuaccacuacaaccaaucaaaagaucccaccaucaaauugauagcaaugcuguacacaccacuuagggcuaauaaugcuggggaagaugucuucacagucucuugccgaguccucacgaggccaucccccgauuuugauuucauauucuuggugccacccacaguugagucaagaucaaaaccauucaccgucccaauucuaacuguugaggaaaugaccuauucaagguuccccauuccuuuggaaaagcuguucacgggucccagcagugccuuuguuguccaaccacaaaauggcaggugcacgacugauggcgugcucuuaggcaccacccaacugucuccugucaacaucugcaccuucagaggggaucucacccacuuugcaggcaccuccgaauacgcaaugaauuuggcuucucaaaauuggacuaauuaugacccaacagaagaaaucccagccccccugggagccccagauuucgugggaaagauccgaggugugcucacucaaaccacaaggggggacggcucgacccgcggccacagggcuacauugagcacugggagcgcccacuucacuccaaagcugggcagcguucgguuuuccacugauacaaacaaugauuuugaagcuggccaaaacacgaaauucaccccagucggugucuuccaggauggcgacaaccaccaaaaugaaccccaacaaugggugcucccaaauuauucaggugcaacugcccacaauguacaccuugccccugccguggcccccgcuuuuccgggugagcaacugcuuuucuucagguccaccaugcccggaugcagcggguaucccaacaugaauuuggauugucuacucccacaggaaugggugcagcacuucuaucaagaggcagccccagcacaaucugacguggcucugcuaagauuugugaacccagauacaaguaggguuuuguuugaaugcaagcuccauaaaucagguuaugucacaguggcccacacuggccagcaugauuugguuauucccccuaauggcuacuuuagauuugauuccugggucaaccaauucuacacacuugcccccaugggaaauggaacggggcguagacgugcauuauaa

SEQ ID NO: 5240 - RNA, 1620 nt, Artificial Sequence
  VP1__Norovirus__AHH44907
augaagauggcgucgaaugacgccagcccaucugauggguccgcagccaaccucgucccagaggucaacaaugagguuauggcuuuggagcccguuguuggugccgcaauugcggcgccuguagcgggccaacaaaauguaauugaccccuggauuagaaauaaauuuguacaagccccugguggagaguucacaguguccccuagaaacgcuccaggugaaauacuauggagcgcacccuuagguccugaucugaaucccuaccuuucccauuuggccaggauguacaaugguuaugcagguggcuuugaagugcagguaauccucgcggggaacgcguucaccgccgggaaaaucauauuugcagcagucccaccaaauuucccaacugaaggcuuaagucccagccaggucacuauguucccccauauaguaguagauguuagacaacuggaaccuguguugauccccuuacccgaugucaggaauaauuucuaccacuacaaccaaucaaaagaccccaccaucaaauugauagcaaugcuguacacaccacuuagggcuaauaaugcuggggaagaugucuucacagucucuugccgaguccucacgaggccaucccccgauuuugauuucauauucuuggugccacccacaguugagucaagaucaaaaccauucaccgucccaauuuuaacuguugaggaaaugaccaauucaagguuccccauuccuuuggaaaagcuguucacgggucccagcggugccuuuguuguccaaccacaaaauggcaggugcacgacugauggcgugcucuuaggcaccacccaacugucuccugucaacaucugcaccuucagaggggaucucacccacuuugcaggcacccacgaauacgcaaugaauuuggcuucucaaaauuggaauaauuaugacccaacagaagaaaucccagccccucugggagccccagauuucgugggaaagauccgaggugugcucacucaaaccacaaggagggacgguucgacccgcggccacagggcuacauugagcacugggagcgcccacuucacuccaaagcugggcagcauucgguuuuccacugauacaaacaaugauuuugaagcuggccaaaacacgaaauucaccccagucggugucuuccaggauggcgacaaccaccaaaaugaaccccaacaaugggugcucccaaauuauucaggugcaacugcccacaauguacaccuugccccugccguggcccccgcuuuuccgggugagcaacugcuuuucuucagguccaccaugcccggaugcagcggguaucccaacaugaauuuggauugucuacucccacaggaaugggugcagcacuucuaucaagaggcagccccagcacaaucugauguggcucugcuaagauuugugaacccagauacaaguaggguuuuguuugagugcaagcuccauaaaucagguuaugucacaguggcccauacuggccagcaugauuugguuauccccccuaauggcuacuuuagauuugauuccugggucaaccaauucuacacacuugcccccaugggaaauggaacggggcguagaugugcauuauaa

SEQ ID NO: 5241 - RNA, 1620 nt, Artificial Sequence
  VP1__Norovirus__AHH44908
augaagauggcgucgaaugacgccagcccaucugauggguccgcagccaaccucgucccagaggucaacaaugagguuauggcuuuggagcccguuguuggugccgcaauugcggcgccuguagcgggccaacaaaauguaauugaccccuggauuagaaauaauuuuguacaagccccugguggagaguucacaguguccccuagaaacgcuccaggugaaauacuauggagcgcacccuuaggcccugaucugaaucccuaccuuucccauuuggccaggauguacaaugguuaugcagguggcuuugaagugcagguaauccucgcggggaacgcguucaccgccgggaaaaucauauuugcagcagucccaccaaauuucccaacugaaggcuuaaguccuagccaggucacuauguucccccacauaguaguagauguuagacaacuggaaccuguguugauccccuuacccgaugucaggaauaauuucuaucacuacaaucaaucaaaagaccccaccaucaaauugauagcaaugcuguacacaccacuuagggcuaauaaugcuggggaagaugucuucacagucucuugccgaguccucacgaggccaucccccgauuuugauuucauauucuuggugccacccacaguugagucaagaucaaaaccauucaccgucccaauucuaacuguugaggaaaugaccaauucaagguuccccauuccuuuggaaaagcuguucacgggucccagcagugccuuuguuguccaaccacaaaauggcaggugcacgacugauggcgugcucuuaggcaccacccaacugucuccugucaacaucugcaccuucagaggggaucucacccacuuugcaggcaccuccgaauacgcaaugaauuuggcuucucaaaauuggacuaauuaugacccaacagaagaaaucccagccccccugggagccccagauuucgugggaaagauccgaggugugcucacucaaaccacaaggggggacggcucgacccgcggccacagggcuacauugagcacugggagcgcccacuucacuccaaagcugggcagcguucgguuuuccacugauacaaacaaugauuuugaagcuggccaaaacacgaaauucaccccagucggugucuuccaggauggcgacaaccaccaaaaugaaccccaacaaugggugcucccaaauuauucaggugcaacugcccacaauguacaccuugccccugccguggcccccgcuuuuccgggugagcaacugcuuuucuucagguccaccaugcccggaugcagcggguaucccaacaugaauuuggauugucuacucccacaggaaugggugcagcacuucuaucaagaggcagccccagcacaaucugacguggcucugcuaagauuugugaacccagauacaaguaggguuuuguuugaaugcaagcuccauaaaucagguuaugucacaguggcccacacuggccagcaugauuugguuauucccccuaauggcuacuuuagauuugauuccugggucaaccaauucuacacacuugcccccaugggaaauggaacggggcguagacgugcauuauaa

SEQ ID NO: 5242 - RNA, 1620 nt, Artificial Sequence
  VP1__Norovirus__AHH44909
augaagauggcgucgaaugacgccagcccaucugauggguccgcagccaaccucgucccagaggucaacaaugagguuauggcuuuggagcccguuguuggugccgcaauugcggcgccuguagcgggccaacaaaauguaauugaccccuggauuagaaauaauuuuguacaagccccugguggagaguucacaguguccccuagaaacgcuccaggugaaauacuauggagcgcacccuuaggcccugaucugaaucccuaccuuucccauuuggccaggauguacaaugguuaugcagguggcuuugaagugcagguaauccucgcggggaacgcguucaccgccgggaaaaucauauuugcagcagucccaccaaauuucccaacugaaggcuuaagucccagccaggucacuauguucccccacauaguaguagauguuagacaacuggaaccuguguugauccccuuacccgaugucaggaauaauuucuaccacuauaaucaaucaaaagaccccaccaucaaauugauagcaaugcuguacacaccacuuagggcuaauaaugcuugggaagaugucuucacagucucuugccgaguccucacgaggccaucccccgauuuugauuucauauucuuggugccacccacaguugagucaagaucaaaaccauucaccgucccaauuuuaacuguugaggaaaugaccaauucaagguuccccauuccuuuggaaaagcuguucacgggucccagcggugccuuuguuguccaaccacaaaauggcaggugcacgacugauggcgugcucuuaggcaccacccaacugucuccugucaacaucugcaccuucagaggggaucucacccacuuugcaggcacccacgaauacgcaaugaauuuggcuucucaaaauuggaauaauuaugacccaacagaagaaaucccagccccucugggagccccagauuucgugggaaagauccgaggugugcucacucaaaccacaaggagggacgguucaacccgcggccacagggcuacauugagcacugggagcgcccacuucacuccaaagcugggcagcauucgguuuuccacugauacaaacaaugauuuugaagcuggccaaaacacgaaauucaccccagucggugucuuccaggauggcgacaaccaccaaaaugaaccccaacaaugggugcucccaaauuauucaggugcaacugcccacaauguacaccuugccccugccguggcccccgcuuuuccgggugagcaacugcuuuucuucagguccaccaugcccggaugcagcggguaucccaacaugaauuuggauugucuacuuccacaggaaugggugcagcacuucuaucaagaggcagccccagcacaaucugauguggcucugcuaagauuugugaacccagauacaagcaggguuuuguuugagugcaagcuccauaaaucagguuaugucacaguggcccauacuggccagcaugauuugguuauccccccuaauggcuacuuuagauuugauuccugggucaaccaauucuacacacuugcccccaugggaaauggaacggggcguagacgugcauuauaa

SEQ ID NO: 5243 - RNA, 1620 nt, Artificial Sequence
  VP1__Norovirus__AHH44911
augaagauggcgucgaaugacgccagcccaucugauggguccgcagccaaccucgucccagaggucaacaaugagguuauggcuuuggagcccguuguuggugccgcaauugcggcgccuguagcgggccaacaaaauguaauugaccccuggauuagaaauaauuuuguacaagccccugguggagaguucacaguguccccuagaaacgcuccaggugaaauacuauggagcgcacccuuaggcccugaucugaaucccuaccuuucccauuuggccaggauguacaaugguuaugcagguggcuuugaagugcagguaauccucgcggggaacgcguucaccgccgggaaaaucauauuugcagcagucccaccaaauuucccaacugaaggcuuaagucccagccaggucacuauguucccccacauaguaguagauguuagacaacuggaaccuguguugauccccuuacccgaugucaggaauaauuucuaccacuauaaucaaucaaaagaccccaccaucaaauugauagcaaugcuguacacaccacuuagggcuaauaaugcuggggaagaugucuucacagucucuugccgaguccucacgaggccaucccccgauuuugauuucauauucuuggugccacccacaguugagucaagaucaaaaccauucaccgucccaauuuuaacuguugaggaaaugaccaauucaagguuccccauuccuuuggaaaagcuguucacgggucccagcggugccuuuguuguccaaccacaaaauggcaggugcacgacugauggcgugcucuuaggcaccacccaacugucuccugucaacaucugcaccuucagaggggaucucacccacuuugcaggcacccacgaauacgcaaugaauuuggcuucucaaaauuggaauaauuaugacccaacagaagaaaucccagccccucugggagccccagauuucgugggaaagauccgaggugugcucacucaaaccacaaggagggacgguucaacccgcggccacagggcuacauugagcacugggagcgcccacuucacuccaaagcugggcagcauucgguuuuccacugacacaaacaaugauuuugaagcuggccaaaacacgaaauucaccccagucggugucuuccaggauggcgacaaccaccaaaaugaaccccaacaaugggugcucccaaauuauucaggugcaacugcccacaauguacaccuugccccugccguggccccugcuuuuccgggugagcaacugcuuuucuucagguccaccaugcccggaugcagcggguaucccaacaugaauuuggauugucuacuuccacaggaaugggugcagcacuucuaucaagaggcagccccagcacaaucugauguggcucugcuaagauuugugaacccagauacaagcaggguuuuguuugagugcaagcuccauaaaucagguuaugucacaguggcccauacuggccagcaugauuugguuauccccccuaauggcuacuuuagauuugauuccugggucaaccaauucuacacacuugcccccaugggaaauggaacggggcguagacgugcauuauaa

SEQ ID NO: 5244 - RNA, 1620 nt, Artificial Sequence
  VP1__Norovirus__AHH44912
augaagauggcgucgaaugacgccagcccaucugauggguccgcagccaaccucgucccagaggucaacaaugagguuauggcuuuggagcccguuguuggugccgcaauugcggcgccuguagcgggccaacaaaauguaauugaccccuggauuagaaauaauuuuguacaagccccugguggagaguucacaguguccccuagaaacgcuccaggugaaauacuauggagcgcacccuuaggcccugauuugaaucccuaccuuucccauuuggccaggauguacaaugguuaugcagguggcuuugaagugcagguaauccucgcggggaacgcguucaccgccgggaaaaucauauuugcagcagucccaccaaauuucccaacugaaggcuuaagucccagccaggucacuauguucccccacauaguaguagaugucagacaacuggaaccuguguugauccccuuacccgaugucaggaauaauuucuaccacuacaaucaaucaaaagaccccaccaucaaauugauagcaaugcuguacacaccacuuagggcuaauaaugcuggggaagaugucuucacagucucuugccgaguccucacgaggccaucccccgauuuugauuucauauucuuggugccacccacaguugagucaagaucaaaaccauucaccgucccaauuuuaacuguugaggaaaugaccaauucaagguuccccauuccuuuggaaaagcuguucacgggucccagcggugccuuuguuguccaaccacaaaauggcaggugcacgacugauggcgugcucuuaggcaccacccaacugucuccugucaacaucugcaccuucagaggggaucucacccacuuugcaggcacccacgaauacgcaaugaauuuggcuucucaaaauuggaguaauuaugacccaacagaagaaaucccagccccccugggagccccagauuucgugggaaagauccgaggugugcucacucaaaccacaaggggggacggcucgacccgcggccacagggcuacauugagcacugggagcgcccacuucacuccaaagcugggcagcauucgguuuuccacugauacaaacaaugauuuugaagcuggccaaaacacgaaauucaccccagucggugucuuccaggauggcgacaaccaccaaaaugaaccccaacaaugggugcucccaaauuauucaggugcaacugcccacaauguacaccuugccccugccguggcccccgcuuuuccgggugagcaacugcuuuucuucagguccaccaugcccggaugcagcggguaucccgacaugaauuuggauugucuacucccacaggaaugggugcagcacuucuaucaagaggcagccccagcacaaucugauguggcucugcuaagauuugugaacccagauacaaguaggguuuuguuugagugcaagcuccauaaaucagguuaugucacaguggcccauacuggccagcaugauuugguuauccccccuaauggcuacuuuagauuugauuccugggucaaccaauucuacacacuugcccccaugggaaauggaacggggcguagacgugcauuauaa

SEQ ID NO: 5245 - RNA, 1620 nt, Artificial Sequence
  VP1__Norovirus__AHH44913
augaagauggcgucgaaugacgccagcccaucugauggguccgcagccaaccucgucccagaggucaacaaugagguuauggcuuuggagcccguuguuggugccgcaauugcggcgccuguagcgggccaacaaaauguaauugaccccuggauuagaaauaauuuuguacaagccccugguggagaguucacaguguccccuagaaacgcuccaggugaaauacuauggagcgcacccuuaggcccugaucugaaucccuaccuuucccauuuggccaggauguacaaugguuaugcagguggcuuugaagugcagguaauccucgcggggaacgcguucaccgccgggaaaaucauauuugcagcagucccaccaaauuucccaacugaaggcuuaagucccagccaggucacuauguucccccauauaguaguagauguuagacaacuggaaccuguguugauccccuuacccgauguuaggaauaauuucuaccacuauaaccaaucaaaagaccccaccaucaaauugauagcaaugcuguacacaccacuuagggcuaauaaugcuggggaagaugucuucacagucucuugccgaguccucacgaggccaucccccgauuuugauuucauauucuuggugccacccacaguugagucaagaucaaaaccauucaccgucccaauucuaacuguugaggaaaugaccaauucaagguuccccauuccuuuggaaaagcuguucacgggucccagcagugccuuuguuguccaaccacaaaauggcaggugcacgacugauggcgugcucuuaggcaccacccaacugucuccugucaacaucugcaccuucagaggggaucucacccacuuugcaggcaccuccgaauacgcaaugaauuuggcuucucaaaauuggacuaauuaugacccaacagaagaaaucccagccccccugggagccccagauuucgugggaaagauccgaggugugcucacucaaaccacaaggagggacggcucgacccgcggccacagggcuacacugagcacugggagcgcccacuucacuccaaagcugggcagcauucgguuuuccacugauacaaacaaugauuuugaagcuggccaaaacacgaaauucaccccagucggugucuuccaggauggcgacaaccaccaaaaugaaccccaacaaugggugcucccaaauuauucaggugcaacugcccacaauguacaccuugccccugccguggcccccgcuuuuccgggugagcaacugcuuuucuucagguccaccaugcccggaugcagcggguaucccaacaugaauuuggauugucuacuuacacaggaaugggugcagcacuucuaucaagaggcagccccagcacaaucugauguggcucugcuaagauuugugaacccagauacaaguaggguuuuguuugagugcaagcuccauaaaucagguuaugucacaguggcccauacuggccagcaugauuugguuauccccccuaauggcuacuuuagauuugauuccugggucaaccaauucuacacucuugcccccaugggaaauggaacggggcguagacgugcauuauaa

SEQ ID NO: 5246 - RNA, 1620 nt, Artificial Sequence
  VP1__Norovirus__AHH44914
augaagauggcgucgaaugacgccagcccaucugauggguccgcagccaaccucguuccagaggucaacaaugagguuauggcuuuggagcccguuguuggugccgcaauugcggcgccuguagcgggccaacaaaauguaauugaccccuggauuagaaauaauuuuguacaagccccugguggagaguucacaguguccccuagaaacgcuccaggugaaauacuauggagcgcacccuuaggcccugaucugaaucccuaccuuucccauuuggccaggauguacaaugguuaugcagguggcuuugaagugcagguaauccucgcggggaacgcguucaccgccgggaaaaucauauuugcagcagucccaccaaauuucccaacugaaggcuuaagucccagccaggucacuauguucccccacauaguaguagauguuagacaacuggaaccuguguugauccccuuacccgaugucaggaauaauuucuaccacuauaaucaaucaaaagaccccaccaucaaauugauagcaaugcuguacacaccacuuagggccaauaaugcuggggaagaugucuucacagucucuugccgaguccucacgagaccaucccccgauuuugauuucauauucuuggugccacccacaguugagucaagaucaaaaccauucaccgucccaauuuuaacuguugaggaaaugaccaauucaagguuccccauuccuuuggaaaagcuguucacgggucccagcagcgccuuuguuguccaaccacaaaauggcaggugcacgacugauggcgugcucuuaggcaccacccaacugucuccugucaacaucugcaccuucagaggggaucucacccacuuugcaggcacccacgaauacgcaaugaauuuggcuucucaaaauuggacuaauuaugacccaacagaagaaaucccagccccccugggagccccagauuucgugggaaagauccgaggugugcucacucaaaccacaaggggggacggcucgacccgcggccacagggcuacauugagcacugggagcgcccacuucacuccaaagcugggcagcguucgguuuuccacugauacaaacaaugauuuugaagcuggccaaaacacgaaauucaccccagucggugucuuccaggauggcgacaaccaccaaaaugaaccccaacaaugggugcucccaaauuauucaggugcaacugcccacaauguacaccuugccccugccguggcccccgcuuuuccgggugagcaacugcuuuucuucagguccaccaugcccggaugcagcggguaucccaacaugaauuuggauugucuacuuccacaggaaugggugcagcacuucuaucaagaggcagccccagcacaaucugauguggcucugcuaagauuugugaacccagauacaagcaggguuuuguuugagugcaagcuccauaaaucagguuaugucacaguggcccauacuggccagcaugauuugguuauccccccuaauggcuacuuuagauuugauuccugggucaaccaauucuacacacuugcccccaugggaaauggaacggggcguagacgugcauuauaa

SEQ ID NO: 5247 - RNA, 1620 nt, Artificial Sequence
  VP1__Norovirus__AHH44915
augaagauggcgucgaaugacgccagcccaucugauggguccgcagccaaccucgucccagaggucaacaaugagguuauggcuuuggagcccguuguuggugccgcaauugcggcgccuguagcgggccaacaaaauguaauugaccccuggauuagaaauaauuuuguacaagccccugguggagaguucacaguguccccuagaaacgcuccaggugaaauacuauggagcgcacccuuaggcccugauuugaaucccuaccuuucccauuuggccaggauguacaaugguuaugcagguggcuuugaagugcagguaauccucgcggggaacgcguucaccgccgggaaaaucauauuugcagcagucccaccaaauuucccaacugaaggcuuaagucccagccaggucacuauguucccccacauaguaguagaugucagacaacuggaaccuguguugauccccuuacccgaugucaggaauaauuucuaccacuacaaucaaucaaaagaccccaccaucaaauugauagcaaugcuguacacaccacuuagggcuaauaaugcuggggaagaugucuucacagucucuugccgaguccucacgagaccaucccccgauuuugauuucauauucuuggugccacccacaguugagucaagaucaaaaccauucaccgucccaauucuaacuguugaggaaaugaccaauucaagguuccccauuccuuuggaaaagcuguucacgggucccagcagugccuuuguuguccaaccacaaaauggcaggugcacgacugauggcgugcucuuaggcaccacccaacugucucccgucaacaucugcaccuucagaggggaucucacccacuuugcaggcaccuccgaauacgcaaugaauuuggcuucucaaaauuggacuaauuaugacccaacagaagaaaucccagccccucugggagccccagauuucgugggaaagauccgaggugugcucacucaaaccacaaggagggacgguucaacccgcggccacagggcuacacugagcacugggagcgcccacuucacuccaaagcugggcagcauucgguuuuccacugauacaaacaaugauuuugaagcuggccaaaacacgaaauucaccccagucggugucuuccaggauggcgacaaccaccaaaaugaaccccaacaaugggugcucccaaauuauucaggugcaacugcccacaauguacaccuugccccugccguggcccccgcuuuuccgggugagcaacugcuuuucuucagguccaccaugcccggaugcagcggguaucccaacaugaauuuggauugucuacuuccacaggaaugggugcagcacuucuaucaagaggcagccccagcacaaucugacguggcucugcuaagauuugugaacccagauacaaguaggguuuuguuugagugcaagcuccauaaaucaggcuaugucacaguggcccauacuggccagcaugauuugguuauccccccuaaugguuacuuuagauuugauuccugggucaaccaauucuacacacuugcccccaugggaaauggaacggggcguagacgugcauuauaa

SEQ ID NO: 5248 - RNA, 1623 nt, Artificial Sequence
  VP1__Norovirus__AID60853
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaccauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaauucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5249 - RNA, 1623 nt, Artificial Sequence
  VP1__Norovirus__AID60855
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaccauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaauucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5250 - RNA, 1623 nt, Artificial Sequence; identical to SEQ ID NO: 5249
  VP1__Norovirus__AID60857

SEQ ID NO: 5251 - RNA, 1623 nt, Artificial Sequence; identical to SEQ ID NO: 5249
  VP1__Norovirus__AID60859

SEQ ID NO: 5252 - RNA, 1623 nt, Artificial Sequence
  VP1__Norovirus__AID60861
augaagauggcgucgagugacgccaacccaucugauggguccgcagccagccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaccauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacauugggagcgccgacuuugcuccaaaacuggguagaguucaauuugaaacugacacagaccaugauuuugaagcuaaccaaaacacaaaauucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5253 - RNA, 1623 nt, Artificial Sequence
  VP1__Norovirus__AID60863
augaagauggcgucgagugacgccaacccaucugauggguccgcagccagccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaccauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaauucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5254 - RNA, 1623 nt, Artificial Sequence
  VP1__Norovirus__AID60865
augaagauggcgucgagugacgccaacccaucugauggguccgcagccagccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauguaguaauagauguuaggcaacuagaaccuguguugauucccuuacccgauguuaggaauaauuucuaccauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaaacuaaccaaaacacaaaauucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5255 - RNA, 1623 nt, Artificial Sequence
  VP1__Norovirus__AID60869
augaagauggcgucgagugacgccaacccaucugauggguccgcagccagccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaccauuacaaucaaucaaaugaccccaccauuaaguugauagcaauguuguauacaccacuuagggcuaauaaugcuggggaugaugucuucacaguuucuugccgaguucucacgagaccaucccccgauuuugauuuuauauuucuagugccacccacaguugagucaagaacuaaaccauucucugucccaguuuuaacuguugaggagaugaccaauucaagauuccccauuccuuuggaaaagcuguucacgggucccagcagugccuuuguuguccaaccacaaaacgguaggugcacgacugauggcgugcuccuaggcaccacccaacugucuccugucaacaucugcaccuucagaggagaugucacccauaucacagguagucauaacuacacaaugaauuuggcuucucaaaauuggagcaauuaugacccaacagaagaaaucccagccccucuaggaacuccagauuuuguggggaagauucaaggcgugcucacccaaaccacaaggacaaauggcucaacacgcggccacaaagccacaguguacgcugggagcgccaacuuugcuccaaaacuggguagaguucaauuugaaacugacacagaccaugaucuugaagcuaaccaaaacacaaaauucaccccaguuggugucauccaagaugguaacaccacccaccgaaaugaaccccaacagugggugcucccaaguuacucaggcagaaguacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucgggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5256 - RNA, 1623 nt, Artificial Sequence
  VP1__Norovirus__AID60871
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaccauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccacuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaauucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5257 - RNA, 1623 nt, Artificial Sequence
  VP1__Norovirus__AID60875
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccggaaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaccauuacaaucaaucaaaugacuccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccacuccuuuggaaaaguuguucacgggucccagcagugccuuuguuguucaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuucguggggaagauucaaggcgugcucacccaaaccacaaggacagauggcucaacacgcggccacaaagccacaguguacacugggagcgccgacuuugcuccaaaacugggcagaguucaauuugaaacugacacagaccaugauuuugaaacuaaccaaaacacaaaauucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugaauccugggucaaccaguuuuacacgcuugcccccaugggaaauggaacggggcguagacgugcacuauaa

SEQ ID NO: 5258 - RNA, 1623 nt, Artificial Sequence
  VP1__Norovirus__AID60877
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccggaaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaccauuacaaucaaucaaaugacuccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccacuccuuuggaaaaguuguucacgggucccagcagugccuuuguuguucaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuucguggggaagauucaaggcgugcucacccaaaccacaaggacagauggcucaacacgcggccacaaagccacaguguacacugggagcgccgacuuugcuccaaaacugggcagaguucaauuugaaacugacacagaccaugauuuugaaacuaaccaaaacacaaaauucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5259 - RNA, 1623 nt, Artificial Sequence; identical to SEQ ID NO: 5258
  VP1__Norovirus__AID60879

SEQ ID NO: 5260 - RNA, 1623 nt, Artificial Sequence
  VP1__Norovirus__AID60881
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccggaaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaccauuacaaucaaucaaaugacuccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccacuccuuuggaaaaguuguucacgggucccagcagugccuuuguuguucaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuucguggggaagauucaaggcgugcucacccaaaccacaaggacagauggcucaacacgcggccacaaagccacaguguacacugggagcgccgacuuugcuccaaaacugggcagaguucaauuugaaacugacacagaccaugauuuugaaacuaaccaaaacacaaaauucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccauacccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5261 - RNA, 1623 nt, Artificial Sequence
  VP1__Norovirus__AID60883
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaauauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccggaaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaccauuacaaucaaucaaaugacuccaccauuaaguugauagcaauguuguauacaccacuuagggcuaauaaugcuggggaugaugucuucacaguuucuugccgaguucucacgagaccaucccccgauuuugaucucauauuucuagugccacccacaguugagucaagaacuaaaccauucucugucccaguuuuaacuguugaggagaugaccaauucaagauuccccacuccuuuggaaaaguuguucacgggucccagcagugccuuuguuguucaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuucguggggaagauucaaggcgugcucacccaaaccacaaggacagauggcucaacacgcggccacaaagccacaguguacacugggagcgccgacuuugcuccaaaacugggcagaguucaauuugaaacugacacagaccaugauuuugaaacuaaccaaaacacaaaauucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccauacccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5262 - RNA, 1623 nt, Artificial Sequence
  VP1__Norovirus__AID60885
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuuaaaucccuaccuaucccauuuggccagaauguacaaugguuaugcaggugguuuugaagugcaggugauucucgcggggaacgcguucaccgccggaaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaccauuacaaucaaucaaaugacuccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccacuccuuuggaaaaguuguucacgggucccagcagugccuuuguuguucaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuucguggggaagauucaaggcgugcucacccaaaccacaaggacagauggcucaacacgcggccacaaagccacaguguacacugggagcgccgacuuugcuccaaaacugggcagaguucaauuugaaacugacacagaccaugauuuugaaacuaaccaaaacacaaaauucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5263 - RNA, 1623 nt, Artificial Sequence
  VP1__Norovirus__AID60887
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuuaaaucccuaccuaucccauuuggccagaauguacaaugguuaugcaggugguuuugaagugcagguaauucucgcggggaacgcguucaccgccggaaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaccauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccacuccuuuggaaaaguuguucacgggucccagcagugccuuuguuguucaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuucguggggaagauucaaggcgugcucacccaaaccacaaggacagauggcucaacacgcggccacaaagccacaguguacacugggagcgccgacuuugcuccaaaacugggcagaguucaauuugaaacugacacagaccaugauuuugaaacuaaccaaaacacaaaauucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5264 - RNA, 1623 nt, Artificial Sequence
  VP1__Norovirus__AID60889
augaagauggcgucgagugacgccaacccuugugauggguccgcagccaaccucgucccagaggucaacaaugagguuauggcucuggagcccguuguuggugccgccauugcggcaccuguaggcggccaacaaaauguaauugaccccuggauuagaaauaauuuuguacaagccccugguggagaguuuacaguauccccuagaaacgcuccaggugaaauacuauggagcgcgcccuugggcccugauuuaaaucccuaccuaucccauuuggccagaauguacaaugguuaugcaggugguuuugaagugcaggugauucucgcggggaacgcguucaccgccggaaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaccauuacaaucaaucaaaugacuccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccacuccuuuggaaaaguuguucacgggucccagcagugccuuuguuguucaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuucguggggaagauucaaggcgugcucacccaaaccacaaggacagauggcucaacacgcggccacaaagccacaguguacauugggagcgccgacuuugcuccaaaacugggcagaguucaauuugaaacugacacagaccaugauuuugaaacuaaccaaaacacaaaauucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccuugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5265 - RNA, 1623 nt, Artificial Sequence
  VP1__Norovirus__AID60893
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuuaaaucccuaccuaucccauuuggccagaauguacaaugguuaugcaggugguuuugaagugcaggugauucucgcggggaacgcguucaccgccggaaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaccauuacaaucaaucaaaugacuccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccacuccuuuggaaaaguuguucacgggucccagcagugccuuuguuguucaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuucguggggaagauucaaggcgugcucacccaaaccacaaggacagauggcucaacacgcggccacaaagccacaguguacauugggagcgccgacuuugcuccaaaacugggcagaguucaauuugaaacugacacagaccaugauuuugaaacuaaccaaaacacaaaauucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccuugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5266 - RNA, 1623 nt, Artificial Sequence
  VP1__Norovirus__AID68577
augaagauggcgucgagugacgccaacccaucugauggguccgcagccaaccucgucccagaggucaacaaugagguuauggcucuggagcccguuguaggugccgccauugcggcaccuguagcgggccaacaaaauguaauugaccccuggauuagaaauaauuuuguacaagccccugguggagaguucacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcaugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggccccugcuguagcccccacuuuuccgggugagcaacuucucuucuucagauccaccaugcccggaugcagcggguaccccaacauggauuuggacugucuacucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaauggcuauuuuagguuugauuccugggucaaccaguuuuacacgcuugcccccaugggaaauggaacggggcguagacgugcacuauaa

SEQ ID NO: 5267 - RNA, 1623 nt, Artificial Sequence
  VP1__Norovirus__AID68578
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggcuagaauguacaaugguuaugcaggugguuuugaagugcagguaauucucgcggggaaugcguucaccgccgggaaggucauauuugcagcagucccaccaaauuuuccaacugaaggcuugagccccagccaggucacuauguuuccccauauaguaguagauguuaggcaacuagaaccuguguugauucccuuacccgauguuaggaauaauuucuaucauuacaaucaaucaaaugaccccaccauuaaguugauagcaauguuguacacaccacuuagggcuaauaaugcuggggaugaugucuuuacaguuucuugccgaguucucacgagaccaucccccgauuuugauuuuauauuucuagugccacccacaguugagucaaggacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucauaacuauacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgauuuuucuccaaaacuggguagaauucaauuugaaacugacacaaaccaugauuuugaagcuaaccaaaacacaaaguucaccccaguuggugucauccaagaugguggcaccacccaccgaaaugaaccccaacagugggugcucccaaguuacucgggcagaaauacuccuaaugugcaucuggcccccgcuguggcccccacuuuuccgggugagcaacuucucuuuuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggucaacaugauuugguuaucccccccaaugguuauuuuagguuugauuccugggucaaucaguuuuacacgcuugcccccaugggaaauggaacggggcguagacgugcacuauaa

SEQ ID NO: 5268 - RNA, 1623 nt, Artificial Sequence
  VP1__Norovirus__AID68579
augaagauggcgucgagugacgccaacccaucugauggguccgcagccaaccucgucccagaggucaacaaugagguuuuggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugaucuaaaucccuaccuaucccauuuggcuagaauguacaaugguuaugcaggugguuuugaagugcagguaauucucgcggggaaugcguucaccgccgggaaggucauauuugcagcagucccaccaaauuuuccaacugaaggcuugagccccagccaggucacuauguuuccccauauaguaguagauguuaggcaacuagaaccuguguugauucccuuacccgauguuaggaauaauuucuaucauuacaaucaaucaaaugaccccaccauuaaguugauagcaauguuguacacaccacuuagggcuaauaaugcuggggaugaugucuuuacaguuucuugccgaguucucacgagaccaucccccgauuuugauuuuauauuucuagugccacccacaguugagucaaggacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucauaacuauacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgauuuuucuccaaaacuggguagaauucaauuugaaacugacacaaaccaugauuuugaagcuaaccaaaacacaaaguucaccccaguuggugucauccaagaugguggcaccacccaccgaaaugaaccccaacagugggugcucccaaguuacucgggcagaaauacuccuaaugugcaucuggcccccgcuguggcccccacuuuuccgggugagcaacuucucuuuuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucagguuauguuacaguggcucacacuggucaacaugauuugguuaucccccccaaugguuauuuuagguuugauuccugggucaaucaguuuuacacgcuugcccccaugggaaauggaacggggcguagacgugcacuauaa

SEQ ID NO: 5269 - RNA, 1623 nt, Artificial Sequence
  VP1__Norovirus__AID68581
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccaucuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaauugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgauuuugcuccaaaacuggguagaguucaauuugaaacugacacagaucaugauuuugaagcuaaccaaaacacaaaguucaccccaguuggugucauccaagaugguggcaccacccaccgaaaugaaccccaacagugggugcucccaaguuacucaggcagaaacacuccuaaugugcaucuggcccccgcuguagcccccacuuuuccgggugagcaacuucucuucuucagauccaccaugcccggauguagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5270 - RNA, 1623 nt, Artificial Sequence
  VP1__Norovirus__AID69174
augaggauggcgucugaugacgccaagucggcccccuccgaccuggagggggccgggcuugucccggccacugcugccccacucccaguugcaccggucgccggcgcgcaggccgcugagcccuucgccggccaaaucaaugugauugaccccuggauuuauacuaauuuuguucaagcacccaccggugaguucacaguuucaccacgcaacacucccggugagguccuagucaaccuugaaauagguccaaaccucaacccauaccuacagcacuuggcacagauguacaacgguuaugcgggugguguggagguacaggugauccuggcggguaacgcguucacggcuggcaagcuacugugcgcgcuaguccccccuggguucccuacgagcuccaucaccccagcucagcugaccaugcucccacacacaaucauugaugugagaacgaccgauccuguggucgugcccaugccagaugugcgccgcacccucuggcacgaagugcgcuccaccacugagccgcuuaugcgacucgugaucauguuguacacaccaaugcgagcaaacucagguucugaugaggccuuuguggucucaggccguguucuauccaggccagcaccagacuucaacuucuucuaccucgugccaccacgcguugaggacacgguugagcccuuuucgcucccugaccuccgcguagaugagaugucauccucccgguggcagaaucccguugucaugcugcaggccgaccccaaccagaacaucgcggcccauuggcaaaauggcaggugcaccauuaacggggagcuacuuggcacgaccccccgaaaccagagcuggcugcuccggaugcgcggaagcguacuggcugcgccagguggccagaaggccgugacggugaacgucgaccucacggagcccgacgggcaggcuuucucugugcuuucuggcaauccuggcccugagggagugcccgacuuccaagccaucuacaauguucgcaugucaacagcgagcaccacagcugggcacaccguagccacgaauggcuauauugagcagucaggauacacccccgccuugggcacccuagucauccaaggcguugaucucagucaaguccccgcccuggguucugaggucacgaugcaaguuguguccaucgaccugaaccauaacauggaccccacuagacuaccagacuacaauggcgcuggguucgacgguucgguggcgcuggcgcccccacucguccccccgcucccgggugagguguuguugagguucaccacgcugccaaucacgacgagucgugguucuucagugucggccacccucgacugugcucugcccgcggaguggaucaccugguuccugguccacaacuucgugccccaaggcgacgcggcgcuccugcguuaccgcaacaggggcacaggccaaauucuuuucgagugcaaauuguacaaggaaggauuccuggcaguugccggugucagcacgaggaccgucuuccccacgagugggguuuucgaguucgugagcuggguccccgucuucuaccaguugaccccugugggaagcucuggggccaggaagcgccaacgauga

SEQ ID NO: 5271 - RNA, 1623 nt, Artificial Sequence
  VP1__Norovirus__AIG59994
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaucuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgaugucaggaauaauuucuaucauuauaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacagucgagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcguacuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacauugggagcgccgacuucgcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucagguagaaauacucauaaugugcaucuggcccccgcuguagcccccaccuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcaguauaa

SEQ ID NO: 5272 - RNA, 1623 nt, Artificial Sequence
  VP1__Norovirus__AIG59996
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaucuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuauaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacagucgagucaagaacuaaaccauucucugucccaauuuuaacuguugaggagaugaccaauucaagauuccccauuccuuuggaaaaguuguucacgggucccagcagugccuuuguuguccaaccacaaaacggcaggugcacgacugauggcguacuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuucgcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucagguagaaauacucauaaugugcaucuggcccccgcuguagcccccaccuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcaguauaa

SEQ ID NO: 5273 - RNA, 1623 nt, Artificial Sequence
  VP1__Norovirus__AIG59998
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgccccugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucagggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5274 - RNA, 1623 nt, Artificial Sequence
  VP1__Norovirus__AIG60000
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaacggacaugcaggcgguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaacuucuaucauuacaaccaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucagucccaguuuuaacuguugaggagaugaccaauucaagauuccccauuccuuuggaaaaguuguucacggguccuagcagcgccuuuguuguccaaccacaaaacggcaggugcacgacugauggcgugcuccuaggcaccacccaacugucuccugucaacaucugcaccuucagaggggaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcaguauaa

SEQ ID NO: 5275 - RNA, 1623 nt, Artificial Sequence
  VP1__Norovirus__AIG60002
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccgccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaacaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuucguuguccaaccacaaaacgguaggugcacgacugauggcgugcuccuaggcaccacccaacugucuccugucaacaucugcaccuucagaggagcugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccauaaagccacaguguacacugggagcgccgacuuugcuccaaaacuggguagaguucaauuugaaacugacacagaccgugauuuugaagcuaaccaaaacaccaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaucaugcccggaugcagcggguaccccaacauggaucuggacugucugcucccccaggaaugggugcaguacuucuaccaagaggcagccccagcacaaucugauguggcccugcuaagauuugugaauccagacacagguaggguuuuguuugaguguaagcuccauaaaucaggcuauguuacaguggcucacacuggccaacaugauuugguuaucccccccaaugguuauuucagguuugauuccugggucaaccaguuuuacacgcuugcccccaugggaaauggaacggggcguagacgugcacuauaa

SEQ ID NO: 5276 - RNA, 1623 nt, Artificial Sequence
  VP1__Norovirus__AIG60004
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguacacaccacuuagggcuaacaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggacuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5277 - RNA, 1623 nt, Artificial Sequence
  VP1__Norovirus__AIG60006
augaagauggcgucgagugacgccaacccaucugauggguccgcagccaaccucgucccagaggucaauaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgccccugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucagggcgugcucacccaaaccacaaggacagauggcucaacacgcggccacaaagccacaguguacacugggagcgccgacuuugcuccaaaacuggguagaguucaguuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcauuauaa

SEQ ID NO: 5278 - RNA, 1623 nt, Artificial Sequence
  VP1__Norovirus__AIG60008
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggggaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5279 - RNA, 1623 nt, Artificial Sequence
  VP1__Norovirus__AIG60010
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccuggcggagaguuuacaguauccccuagaaacgcuccaggugaaauacuauggagcgcgcccuugggcccugaucuaaaucccuaucuaucccauuuggcuagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuauaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacagucgagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcguacuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuucgcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucagguagaaauacucauaaugugcaucuggcccccgcuguagcccccaccuuuccgggugagcaacuucucuucuucagauccaccaugcccggaugcagcggguaccccaacauggauuuggacugucugcucccccaggaaugggugcaguacuucuaccaagaggcagcuccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcaguauaa

SEQ ID NO: 5280 - RNA, 1623 nt, Artificial Sequence
  VP1__Norovirus__AIG60012
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaacaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5281 - RNA, 1623 nt, Artificial Sequence
  VP1__Norovirus__AIG60014
augaagauggcgucgagugacgccaacccaucugauggguccgcagccaaccucgucccagaggucaauaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauuccccuacccgauguuaggaauaacuucuaucauuauaaucaaucaaaugaccccaccauuaaguugauagcaauguuguauacaccacuuagagcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauucccuauucccuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcaguauaa

SEQ ID NO: 5282 - RNA, 1623 nt, Artificial Sequence
  VP1__Norovirus__AIG60016
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaauucaccccaguuggugucauccaagaugguagcaccacccaccgaaaugaaccccaacagugggugcucccaaguuacucaggcagaaauacuccuaaugugcaucuggcccccgcuguagcccccaccuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5283 - RNA, 1623 nt, Artificial Sequence
  VP1__Norovirus__AIG60018
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaaccaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucagguagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5284 - RNA, 1623 nt, Artificial Sequence
  VP1__Norovirus__AIG60020
augaagauggcgucuagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguauaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggccccugcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5285 - RNA, 1623 nt, Artificial Sequence
  VP1__Norovirus__AIG60022
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaagcuggguagaguucaauuugaaacugacacagaccgugauuuugaagcaaaccaaaacacaaaguucaccccaguuggugucauccaagaugguagcaccacccaccgaaaugaaccccaacagugggugcucccaaguuacucaggcagaaauacuccuaaugugcaccuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucuguuaagauuugugaacccagacacagguaggguuuuguuugaguguaagcuucauaaaucagguuaugucacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5286 - RNA, 1623 nt, Artificial Sequence
  VP1__Norovirus__AIG60024
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguguccccuagaaacgcuccaggugaaauacuauggagcgcgcccuugggcccugaucuaaaucccuaucuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcguacuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuucgcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucagguagaaauacucauaaugugcaucuggcccccgcuguagcccccaccuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcaguauaa

SEQ ID NO: 5287 - RNA, 1629 nt, Artificial Sequence
  VP1__Norovirus__AII73717
augaagauggcgucgaaugacgccgcuccaucaaaugauggugcagcuagucucguaccagagggcauuaaugagacuaugccauuggaacccguugcuggugcaucuauugcugccccaguggcgggacaaaccaacauaauugaccccuggauaagaacaaauuuuguacaagccccuaauggagaguuuacagugucaccaagaaauuccccuggagaaauuuuauuaaauuuagaauuaggaccagaucugaauccuuauuuggcccaucuuucaagaauguauaaugguuaugcuggagguguugaggugcaagugcuccuugcugggaacgcguucacagcagguaagauauuguuugcagcaaucccaccuaacuuuccuguagauaugauuagcccagcucaaauuacuaugcuuccccauuugauuguagauguuaggacuuuggaaccuauuaugauacccuugccugauguuaggaauguguucuaucauuuuaauaaucaaccucaaccuagaaugagauuaguggcuaugcucuacaccccauugaggucuaaugguucaggggaugaugucuucacugugucuuguagagugcuaacuaggccaacuccugauuuugaauuuaucuaucuggugcccccuucuguagaguccaaaacuaaaccauucacacuaccaauauuaaccauuucugaauugaccaacucccgguucccuauuccaaucgagcaauuguauacggcuccaaaugagaccaauguuguccagugucagaauggcaggugcaccuuagauggagagcuccagggcacaacccagcuguugucaagugcaguuugcucuuacaggggcaggacuguggccaauaauggggauaauugggaccaaaauuugcuccagcugaccuauccaaauggugcaagcuaugaccccacugaugaagugccggcaccauugggcacucaagauuuuagugggauguuguauggaguguugacccaggacaaugugaaugugagcacaggagaggccaaaaaugcuaagggaauauacauauccaccacuagugggaaauuuaccccaaaaauugggucaauuggauugcauucaauaacugagcacgugcaccccaaccaacagucgcgguucacccccguuggagucgccgugaaugagaacacccccuuccagcaauggguucuaccacauuaugcagguagucucgcucucaacaccaauuuggcaccugcuguugccccgacuuucccuggugagcaauugcuguucuucaggucccgugucccauguguccaaggccuacaggggcaggaugcguucauagauugccuccugccccaagagugggugaaucauuuuuaucaagaggcagccccuucccaagcagacgucgcccuuauuagguaugucaacccugauacuggucgcacgcuguuugaagccaaguugcauagaucagguuucauuacugugucacauacuggugcuuacccucuuguaguccccccaaauggucauuuuagguuugauucuuggguuaaucaauuuuacucacucgcccccaugggaacuggcaaugggcguagaaggauccaguaa

SEQ ID NO: 5288 - RNA, 1623 nt, Artificial Sequence
  VP1__Norovirus__AII73720
augaagauggcgucgaaugacgcuacuccaucaaaugauggugcugccggccucgugccagaaaguaacaaugaggcaauggcucuggaacccguggugggggcgucuuuagccgccccugucacuggccaaacuaauauaauagaccccuggauuagaacuaauuuuguccaagccccuaauggugaauucacaguuuccccuagaaauuccccuggagagauauuggucaauuuggaguuggguccagaacugaacccuuaucuggcacauuuagcuaggauguacaauggcuaugcgggugguauggaggugcaagugaugcucgcggggaacgcguucacugcuggcaagaucaucuuugccgccgugccaccuuacuuuccaguggaaaaucuuagcccuucccaaauaacaauguucccgcaugugauugucgauguuagaaccuuagaaccuguauugcucccaaugccugaugucagaagcacccucuuucacuucaaucaaaaggaugaaccuaagaugagacuuguugccaugcuuuacaccccucuucgcuccaauggcucuggugacgacguuuucacugucucauguaggauccucacuaggcccuccccugaauuugauuucacauacuuggugccaccaacaguagaaucaaagaccaagccauucacacuaccugugcugacccugggagaacuguccaauucuagauucccucucucuauugaugaaauggucaccagcccuaaugaguccauaguuguucagccacagaauggcagggucacacuagauggggagcuguuaggcacaacccaacugcaagcauguaacauuugcuccauaagggggaaagugacaggacaggucccuaaugaacaacacauguggaaccuggagauuacaaaccuaaaugggacgcaauuugacccuacagaugaugucccagccccucuuggugugcccgacuuugcaggugaggucuuugguguacucagccagagaaauagaggugaaagcaacccagcaaacagggcucaugaugcugucguggcuaccuacagugauaaauacaccccuaaauugggcuuagugcaaauugggacuuggaacaccaaugauguugaaaaccagccaacaaaauucaccccaauuggucugaaugaggucgccaauggccaucgauuugaacaguggacuuugccuagguauucuggugcccugacacuaaauaugaauuuagcuccugcuguggccccgcucuuuccuggagagcgccuccuuuucuuccgcucuuacgucccauuaaaagguggauuuggaaacccugcuauagauugucuagugccucaggaguggguccaacauuucuaucaggaaucugccccaucucugggggauguggccuuagucagguacgucaacccagacaccgggcgcguccuuuuugaggccaaacuccacaaagguggguuccugaccgugucaagcacuagcacagggccuguuguggucccagccaauggcuauuucagauuugauuccuggguuaaucaauuuuacucucuugcccccaugggaacugggaaugggcgcagaagguuucaguaa

SEQ ID NO: 5289 - RNA, 1611 nt, Artificial Sequence
  VP1__Norovirus__AII73723
augaagauggcgucgaaugacgcuacuccaucugaugauggugcagccggccucguaccagagaucaacagugagguuauggcucuugaacccgucgcuggggccuccauugcagcccccguagucggccaacagaauauaauugaucccuggauuagaaauaauuuuguacaagccccugcuggugaauucacaguuuccccuagaaacucuccuggagaacuucuacuugauuuggaauuggguccugaacuuaaucccuaucuugcacauuuggccaggauguacaaugggcacgcaggaggaauggaagugcagauaguacuggcugggaaugcguucacagcugguaaaauccuauuugcugccaucccgccuagcuuccccuaugaaaauuugucacccgcucaauugacuauguguccccaugugauaguggaugugagacaauuagaaccagugcuucugccaaugccagauauaagaaauguuuucuaucacuauaaccagaacaauagucccaaacuuaggcuuguagcuaugcuuuauacuccucugagggcuaacaacucaggugaugacguguucacggugucuugccgcguuuuaacacguccuucuccagauuuccaguucaccuuucuggucccaccuacaguugagucuaaaacuaagaauuucacccuucccguucuuagagucucagagaugacaaauucaagguuccccguuguuuuggaccaaauguacacaagcaggaaugaaaacaucauuguccaaccccaaaacggcaggugcacgacugacggugagcugcuuggcacuaccaucuugcagucugugucuauuugcaauuuuaaaggaacaaugcaggcaaagcugaaugaagaaccacgauaccaguuacaacucaccaacuuggaugggucacccauagauccaacagaugauaugccugccccucuuggcacaccagauuuccaggccguguuauauggcguugcaagccaacgcucuuccagagacaaugccaccagggcacaugaugcacagauugacacugcgggugacacauucgccccgaaaauuggccagguucguuuuaaaucaagcucuaaugauuuugaccuacaugacccuacaaaauucacaccuauugguguuaauguggaugaucagcacccuuuuagacaguggucccuaccaaacuacgguggucaccuugcccugaacaaucauuuggcccccgcugugacaccacucuuuccuggcgagcagauuuuguucuucaggucauacauuccaagcgccggaggccacacagauggugcuauggacugcuugcugccccaagaguggguggagcacuucuaccaggaagcugccccuucccaaucugacaucgcacugguaagguucauuaacccugacacaggaagagugcucuuugaagcuaaauugcauaaacaagguuuccucacaauugcagcaucuggagaucacccuauugugaugcccacuaaugguuacuuuagguuugaagcuugggucaacccuuucuauacucucgcccccgugggaacugggucugggcgcaggaggauucaauaa

SEQ ID NO: 5290 - RNA, 1623 nt, Artificial Sequence
  VP1__Norovirus__AII73726
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5291 - RNA, 1623 nt, Artificial Sequence
  VP1__Norovirus__AII73729
augaagauggcgucgagugacgccaacccaucugauggguccgcagccaaccucgucccagaagucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5292 - RNA, 1623 nt, Artificial Sequence; identical to SEQ ID NO: 5290
  VP1__Norovirus__AII73732

SEQ ID NO: 5293 - RNA, 1608 nt, Artificial Sequence
  VP1__Norovirus__AII73735
augaagauggcgucgagugacgccgcuccaucuaaugauggugcagccggucuuguaccagaggcuaacaaugagaccauggcacuugaaccgguggcuggggcuucaauagccgccccacucaccggccaaaacaauauuauagaccccuggauuagauuaaauuuugugcaggcucccaauggagaguucacgguuucaccccgcaacucgcccggggaaguccuauuaaauuuggaauuaggccccgaacuaaauccauaccuagcacaccuuucuagaauguauaaugguuaugcgggugggguugaggugcaaguacuacuggcugggaaugcguucacagcuggaaaacugguguuugccgcaguucccccucauuuuccauuagaaaauauaagcccuggccagauaacuauguucccucauguaauuauugauguuaggacuuuagaaccaguuuuguugccccuuccugauguuaggaauaacuucuuucauuauaaucagcagaaugaaccgaggaugagacuuguagcaaugcuuuauacuccucuuagaucuaaugguucuggugaugauguauucacugucuccugcagggugcucacccgaccuuccccugauuuugauuuuaauuauuugguccccccuacuguugaaucuaaaaccaaacccuucacacucccuaucuugacuauaggggaguuaaccaacuccagguucccugugccuauagaugagcucuacaccagucccaaugagagucugguggugcaaccccagaacgggagaugcgcacuagauggggagcugcagggcacgacucagcuccuccccacggcgaucugcucguucaggggccggaucaaucagaaggugaguggggaaaaccacguuuggaauaugcaggucaccaacauuaacgggaccccuuuugauccaacagaggaugucccggcuccucuaggcaccccagauuucucuggcaagcucuuugguguacuaagcccgagagaccaugauaaugccugcaggagucaugaugcaguaauugcaaccaacucugccaaauucaccccaaaauugggcgcuauacaaauuggcacaugggaagaaaacgaugugcacaucaaccaaccuacuaaguuuacuccaguuggcuuguuugaagaugaagguuucaaccaguggacacuccccaauuauucuggagccuuaacacuuaauaugggguuggccccuccuguggcccccaccuucccuggugaacaaauucuuuucuuuagaucccacauuccucuuaaaggagguguggcggacccaguuauugauugucucuugccucaagaauggauccaacaucuuuaccaagagucggcccccucacaaucagauguagcacugauuagguuuacaaauccagacacaggacguguucuauuugaagcaaaauuacacaggagugguuacaucacaguggccaauacugguagcagaccgauugucguaccagcuaaugguuacuucagguuugacucuuggguuaaucaauucuauucucucgcccccaugggaacuggaaaugggcgcagaagggugcaauaa

SEQ ID NO: 5294 - RNA, 1623 nt, Artificial Sequence; identical to SEQ ID NO: 5216
  VP1__Norovirus__AII73738

SEQ ID NO: 5295 - RNA, 1620 nt, Artificial Sequence
  VP1__Norovirus__AII73741
augaagauggcgucgaaugacgccgcuccaucuaacgauggugcuacaggucucguaccagagaucaacacugagaccuugccucucgagcccguggccggagcggcaauugcugccccuguuacgggccaaaauaauauaauugaucccuggauuagaaauaauuuugugcaggcgccuaauggugaguuuacagucuccccuagaaauuccccuggugaaauuuuaaugaacuuggaguuagggccagaucuuaauccauauuuggcucaccuuucaagaauguacaaugguuaugcuggagguguagaagugcaagugcuccuagcugggaaugcguucacggcaggaaagauccuuuuugcagcaguccccccaaauuuccccguugauaugcucaguccugcucaaaucacaaugcuuccccauuuaauuguagaugucagaacuuuggagcccauuaugaucccucugcccgauguuaggaauguuuucuaucacuuuaauaaccagccugccccaagaaugagauugguugccaugcucuacaccccuuuaagauccaauggguccggugaugacguauucaccgucuccugcaggguguuaaccagaccuacuccggacuuugaguuuacauacuuagucccccccucgguagaguccaaaaccaaaccuuucacccuacccauccuaacaauuggagaguugacaaacucuagauuuccagccccgaucgaucaguuguacacuucacccaacgcugauauaguuguccaaccccaaaauggccggugcacacuggauggugagcuacaagguacaacacaacucuugacaacagcaauaugcucauacaggggcaugacaucaaaccccacuagugacuacugggaugaucaccuccugcaccugguucaccccaauggggcaacauaugacccgaccgaggacgugccagcuccuuuuggcacgcaggacuuucggggcauuuuguaugggauguugacucaaaacccccgaaccuccggggacgaagccgccaacucccaugggaucuacaucucauccaccagugaaaaguucacuccaaaauuggguacaauuggcuuacaccaagugcaaggcgacauagccagcaaccaacagucaaaauucacaccaguagggauagcagugaauggcaacacuccuuucagacagugggaacucccaaacuacucuggugcccucacccucaacacaaaccuugcaccagcgguugggcccaacuucccuggggagcaaauccuuuucuucaggucaaauguuccaaguguucaagguggccaaccuauagagauugauugccugaucccacaagaaugggucucccauuuuuaucaagaaucagccccuucucagagugauguggccuuggucagguaugucaacccugacacagggcgcacaaucuuugaggccaaauugcauaggcagggauuuaucaccauagcggccacuggaagcaaccccguggucgugccucccaauggguauuucagauuugauuccugggucaaccaguuuuaugcacucgcccccaugggaacugggaaugggcgcagaagaguucaguaa

SEQ ID NO: 5296 - RNA, 1623 nt, Artificial Sequence; identical to SEQ ID NO: 5213
  VP1__Norovirus__AII73744

SEQ ID NO: 5297 - RNA, 1623 nt, Artificial Sequence
  VP1__Norovirus__AII73747
augaagauggcgucgaaugacgccgcuccaucuaacgauggugcuacgggccucgucccagagaucaacaacgagacccucccuuuggaaccaguugcgggugcagcaaucgccgcgccugucacuggccaaaauaauauaauugaucccuggauuagaacaaauuuuguacaagcacccaauggagaguucacugucucaccuagaaacuccccuggagaaauucuuuuaaauuuagaauuggguccugauuuaaauccauauuuggcacaucuaucuagaauguacaauggguaugccgguggcguggaaguccaaguccuccuagcagggaacgcguucacugcagggaagauccucuucgcugccguaccaccaaauuucccaguugaauucuugaguccugcacagauuacuauguugccacaccuaauaguugauguuagaacccuugaacccaucaugauaccacucccugauguuaggaacaccuucuuucauuacaacaaucaacccgccaaccgcaugcgauugguggcuauguuguauaccccuuugagaucuaaugguucuggugaugaugucuucacuguuucauguagagugcuaacuaggcccaccccagauuuugaguucacauauuuggucccuccuucaguagagucuaagacuaaacccuuuucucugccuauauuaacaauuucugaauuaaccaauucaagauuuccugcacccauagauucauuguuuacagcccagaauaacaaucucaauguccaaugucagaauggucggugcacacuggauggugaguugcagggaaccacucaauugcugcccucggguauaugugcuuucaggggaagacuaacagcagauguagacggaagucacgaugacagauggcacaugcaguugaccaaccucaauggaacccccuuugauccaacagaggacgugccggcuccguuaggcaccccagacuucacaggccuccucuucggaguggcaagucagaggaauguuggauccaacccaaacaccacuagggcgcacgaggcugugaucuccacaaccaguucacaguuugugccaaaauuaggaucagucaacuuugguaguacuagcaccgacuuccaacuacaacaacccaccaaauucacaccaguuggaaucaagauugaaaguggacacgaauuugaucagugggcccuaccuagauacucaggucauuugacccucaauaugaaccuugccccaccuauugccccaaauuucccuggugagcaguuguuguucuuuagaucaaauguuccuugugcugguggcgucagugauggugucaucgauugcuuguugccucaggaguggauacagcacuucuaucaggagucugcuccaucccagucugauguggcucugaucagguaugucaacccugacacuggccgcacacucuucgaggcgaaacuccacagaacaggcuacaucacuguugcccacucaggugauuauccccucguuguccccuccaauggauauuuuagauuugauuccugggucaaccaguuuuacucacucgcccccaugggaacaggaaaugggcgcagacgggugcaguaa

SEQ ID NO: 5298 - RNA, 1623 nt, Artificial Sequence
  VP1__Norovirus__AII73750
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaauaauuuuguacaagccccugguggagaguuuacaguauccccuagaaacgcuccaggugaaauauuauggagcgcgcccuuaggcccugauuugaaucccuaccuuucccauuuggccagaauguauaaugggcaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaaggacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcucccuuuacuccaaagcugggcaguguucaguucaguacugacacagaaaaugauuuugaaacucaccaaaacacaaaauucaccccagucggugucauccaggaugguggcaccacccaccgaaaugaaccccaacaauggguacucccaaguuauucagguagaaauguccacaauguacaccuagccccugcuguagcccccacuuuuccgggugaacagcuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccucuuugagugcaaacuccauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5299 - RNA, 1623 nt, Artificial Sequence
  VP1__Norovirus__AII73753
augaagauggcgucgaaugacgcuacuccaucaaaugauggugccgccggccucgugccagaaaguaauaaugaggcaauggcucuggaacccguggugggggcgucuuuagccgccccugucacuggccaaacuaauauaauagaccccuggauuagaacuaauuuuguccaagccccuaauggugaauucacaguuuccccuagaaauuccccuggagagauauuggucaauuuggaguuagguccagaacugaacccuuaucuggcacauuuagcuaggauguacaaugguuaugcgggugguauggaagugcaagugaugcucgcggggaacgcguucaccgcuggcaagauuaucuuugccgccgugccaccuuacuuuccaguggaaaaucuuagcccuucccaaauaacaauguucccacaugugauaaucgauguuagaaccuuggaaccuguguugcucccaaugccugaugucagaaguacccuuuuccacuuuaaucaaaaggaugaaccuaagaugagacuuguugccaugcuuuacaccccucuucguucuaaugguucuggugacgacguuuucaccgucucauguaggauucucacuaggcccuccccugaauuugauuuuacauauuugguaccaccaacaguggaaucaaagacuaagccauucacacuaccugugcuaacacugggagaacuguccaacucuagauuuccucucucuauugaugaaauggucaccagucccaaugaguccauaguuguucagccacagaaugguagggucacacuagauggggagcuguuaggcacaacccaacugcaagcaugcaacauuuguuccauaagggggaaggugacagggcaggucccuaaugaacaacacauguggaaccugcagaucacaaaccuaaaugggacgcaauuugacccuacagaugaugucccagccccccuuggugugcccgauuuugcaggugaggucuuugguguacucagccagagaaacagaggugaaagcaacccagcaaacagggcucaugaugcugucguggccaccuacagugacaaguacaccccuaaauugggcuuagugcaaauuggaacuuggaacaccaaugauguugaaaaccagccaacaaaauucaccccaauugguuuaaaugaggucgcuaauggccaucgauuugaacaguggacuuugccuagguauucuggugcccugacauuaaauaugaauuuagccccugcuguggccccgcucuucccuggagagcgucuucuuuucuuccgcucuuacgucccauuaaaagguggauuuggaaacccugcuauagauugucuggugccucaggaguggguccaacauuucuaucaggaaucugcccccucucugggggauguggccuuagucagguacgucaacccagacaccgggcgcguacuuuuugaggccaaacuccacaaagguggguuccugacugugucaaguacuagcacagggccuguugugguuccagccaauggcuauuucagauuugacuccugggucaaucaauuuuacucucuugcccccaugggaacugggaaugggcgcagaagguuucaguaa

SEQ ID NO: 5300 - RNA, 1623 nt, Artificial Sequence; identical to SEQ ID NO: 5213
  VP1__Norovirus__AII73756

SEQ ID NO: 5301 - RNA, 1668 nt, Artificial Sequence
  VP1__Norovirus__AII73759
augaggauggcgucgagugacgcgcccguuucuggcaccgauggugcggcaggacucguuccagagagucaacaagaagucuugccuuuagagcccgucgcgggaguccagcuggcugcucccguugcagggcaaaguaacauaauugaccccuggauuagaaugaauuuugugcaagccccggccggugaguucacuguguccccucggaacgcaccgggugagguacuuauugauuuagaauuaggaccagaauuaaaccccuaucucaaccaccuugcaagaauguauaauggguauguaggaggaauggagguggaaguuguucuugccgggaaugcguucacggcagguaagaucuuguuugcagcugugccccccagcuucccaacccaugguaucucugcagcacaggcuacuaugcuaccccaugugauuguggaugucaggcaguuggagccuguucggcucccccucccugacgucaggaaugugauguuucacuucugucaagagaacaaggagccgcguaugagaauuguggcaauauuguacaccccucuccgugccaacggagcuggugaugauguuuucaccgucucaugucgugugcuaacaagacccucaccagauuuugauuuuauuuucuuggucccccccucuguagagaguaaguugaaacaguuuacccucccaaaccugcagccaaaugagaugaccaauucaagauuucccacagguaucacacagcuuuauaccaguccaaacaccaauuugguuguccaguuccaaaauggcaggugccuacuugaugguacacuucuugguacuaccccugucagagcugcugacaucugcaguuuuagaggggucacaucaacugaaguagaugcaacugacagccccaggguggcagggucacauagaauuaugguacagcuuagggagccagauggagaggaguuuucacccacaggucccaacccugccccuguuggcaccccagacuuucaagcagccauauuuggcacccucagucaaagaaacacugguggagcugggcagaauucuaacagagcccacuucgcauauuucuacacaagaaaccccaccuuugcaccaggcauagggacuguuguauuuucuuuugacaccacugauuuucaaaaucgucaaccuaccaaauuuuccccuucugguguguuugaugaugauucuucugaaccuuucaaucaguuuucccugccauauuauaauggaucacucggugcaguggacgcuggaaaacuggcuccaccuguggcacccaauuauccaggugagcagauucuuuauuucagagggaguguaccuuucaaaggugguuauggagaaggugagauugacaguuugcuuccccaggaauggauuacccauuucuaugcagagcaggcccccacacaaggugacgcagcccugcugcgcuacuacaacccugacacugguagaguccucuuugagugcaaacuccaucgugaaggauucaucacaaucaacuacacgggauccaaugcucuugcugugccggucaauggagucuucagguuugagggcuggguuaacaaauucuacacacugacccccaugggaaauggcaauggccgcagggguagaagaagggaguuauaa

SEQ ID NO: 5302 - RNA, 1668 nt, Artificial Sequence
  VP1__Norovirus__AII73762
augaagauggcgucuaaggacgcaucgccaucuacggaugguacagccaaccucguuccagagagucaacaggagguuuuggcuuugcaaccaguugcuggcgcacaaauagcugcaccuguagcugggcaauucaauguaauugaccccuggauauaucaaaauuuugugcaggcgccugagggagaguucaccgugucaccccguaacuccacaggugaaauccuaaugaauuuggaauuagguccacaguugaauccuuauuuggcccacuuggcacgcauguacaaugcuuaugcuggcgguuuugaagugcaagugcugcuggccggcaaugcuuucaccgcggguaagauaauugugugugccgugccuccaaacuucccucugcaaaauauaucagcugcacaggccacacaacuuccccauguugugguugaugugagacaauuggaacccgugguccuaccucucccagacgugcgugcgggcuucuaccauuacaaucagguugaagagucccguaugcguuugguggccauuuuguacacuccauugaggacuaauucugcaggugacgaugcauuuacagucuccugccgcauccucaccagaccagcaccugauuuuagcuucuuuuucuuaauaccccccacaauagaaucuaaaacaacaccuuucacucugcccagguugccaauaucugagaugacaaacucuagauucccucuugugauaaaggguauggucguggauccuaaucuuccauugcaagcuaacuuccaaaaugguaggaucacacuggauggggagcuccaggguacaacacuacccacuucaaccagcauuggcaggaucucuggcacccacauguccagcaccccaaguaggauuauacagcaugaggacuccggugauuccacccagcccagagucuucaauccaguguggauggauuuaacugagaacaacuggacugaauuccagccauucaaugaccaacccgccccacuugggugcccagacuucaaagccaaaauauugggcacauugauucgccagccuaauaaugguuccuauuauuuugaugcauaucuagauaccagacaacauggcacuuuugcaccauacaccgggcacgccgcuguccacucugaccaacaggcaggccauuuagcccaaggcuacaaaauucaauucuccccaacaggcauugagagugaccaaaacacugacuugaaccagcuucccgacuauggaggggccaugacugucagcaaggggcuggcuccagcggccgcgcccgauuuccccggugagaugauccuuuacuuugucucugacaugccaguccguaacccaaauggggaaaggagggacacugagaucuuguguuugcugccgcaggagauggucacccacuucuacgaacagcaagcccccucccagggugaugucgcgcuugugcguuacaucaaugccgagacugguagagucauguucgagggaaagcugcauagaaauggauucuucacaguuucugccacugcaagaacuuuaauuguaccugauggauauuucagauuugacucuuggguuaauagguuuuacacauuaagccccaugggaacaggcaauggccgcagaagggcucgcaugcuugaguaa

SEQ ID NO: 5303 - RNA, 1638 nt, Artificial Sequence
  VP1__Norovirus__AII73765
augaugauggcgucuaaggacgccccaacaaacauggauggcaccaguggugccggccagcugguaccagaggcaaacacagcugagccuauaucaauggagcccguggcuggggcagcaacagcugccgcaaccgcuggccaaguuaauaugauugaccccuggauaaugaauaauuaugugcaagccccucaaggugaauucaccauaucgccuaacaacacaccaggugauauuuuguuugauuuacaauuaggcccccaccuuaacccuuucuuaucccauuuggcccaaauguauaauggcuggguuggcaauaugaaagugaagguuuuauuggcugguaaugccuucacggcugguaaaauaaucauuagcuguauacccccuggcuuuguugcacaaaauguuucuaucgcucaagcuacuauguucccccauguuauagcugaugucagaguuuuggaacccauugaggugccauuggaagaugugaggaaugugcuguuccacaacaaugacaacacaccaaccaugagguuggugugcaugcucuacacccccuugcgagcuaguggcagcucgucuggaacugaccccuuugugauugcugggcguguuuugacaugcccgagccccgauuuuagcuuuuuguuuuuggucccccccaauguagaacaaaagacuaaaccuuuuagugucccaaaucuuccauugaauacucuuucaaauucgagaguccccucucuaauuaaaucaaugaugguauccagggaccaugggcagaugguucaguuucaaaaugguagggucacccuagaugggcaacugcaaggcaccacgcccacaucagcuagccagcuguguaaaaucaggggcagugucuuccaugcuaauggugggaauggguauaaccugacagaauuggaugggagcccauaccaugcauuugaaagccccgcaccaauaggguuuccagauuuaggugaaugugacuggcacauggaggcuuccccuaccacccaauucaauacuggugauguuauaaaacaaauuaaugucaaacaagaaucagcauuugccccccaccuugguaccauacaggcagacggccugagugaugugagugucaacacuaacaugauagcuaaauugggaugggugucacccgucagugauggacacaaaggagaugucgacccgugggucauuccacgcuaugggucgacuuugacugaggcugcccaauuagccccuccaauauaccccccaggcuuuggugaggccauuguguuuuucaugucggacuucccuauugcccaugguacuaauggcuugagugugccuugcaccauaccccaagaauuugucacccauuuugucaaugaacaggccccuacuagaggggaagcagcccuauuacauuauuuggauccugacacucauaggaaucuuggugaauucaaauuauauccugauggcuucaugacgugugugccuaauuccagugguacuggcccacaaacucucccaaucaauggugucuuuguuuuuguguccuggguuuccagauuuuaucaauuaaagccugugggaacagccggcccggcucguaggcuugggauuaggagaucauaa

SEQ ID NO: 5304 - RNA, 1623 nt, Artificial Sequence; identical to SEQ ID NO: 5290
  VP1__Norovirus__AII73768

SEQ ID NO: 5305 - RNA, 1608 nt, Artificial Sequence
  VP1__Norovirus__AII73771
augaagauggcgucgagugacgccgcuccaucuaaugauggugcagccggucuuguaccagaggcuaacaaugagaccauggcacuugaaccgguggcuggggcuucaauagccgccccacucaccggucaaaacaauauuauagaccccuggauuagauuaaauuuugugcaggcucccaauggggaguucacgguuucaccccgcaacucgcccggggaaguccuauuaaacuuggaauuaggccccgaacuaaauccauaccuagcacaccuuucuagaauguauaaugguuaugcaggugggguugaggugcaaguacuacuggcugggaaugcguucacagcuggaauauugguguuugccgcaguucccccucauuuuccacuagaaaacauaagcccuggucagauaacuauguucccucauguaauuauugauguuaggacuuuagaaccaguuuuguugccccuuccagauguuaggaauaauuucuuucauuauaaucaacagaaugaaccgaggaugagacucguggcaaugcuuuauacuccccuuagaucuaaugguucuggugaugauguauuuacugucucuugcagggugcucacccgaccuuccccugauuuugauuuuaauuacuugguccccccuaccguugaaucuaaaacuaaacccuucacacucccuaucuugacuauaggggaguugaccaacuccagguucccugugcccauagaugagcucuacaccagucccaaugagagucugguggugcaaccccagaaugggagaugcgcgcuagauggggagcugcagggcacgacccagcuccuccccacggcgauuugcucauucaggggccggaucaaucagaaggugaguggagaaaaccauguuuggaauaugcaggucaccaacaucaacgggaccccuuuugauccaacagaggaugucccggcuccucuaggcaccccagauuucucuggcaagcucuuugguguacuaagccagagggaccaugauaaugccuguagaagucaugaugcaguaauugcaaccaacucugccaaauuuacuccaaaauugggcgcuauacaaauuggcacaugggaacaagacgaugugcacaucaaccaaccuacuaaguuuacuccaguuggcuuguuugaaaaugaagguuucaaccaguggacacuccccaauuacucaggagccuuaacacuuaauaugggguuggccccuccuguggcccccaccuucccuggugaacaaauccuuuucuuuagaucccacauuccucuuaaaggagguguggcggacccaguuauugauugucucuugccccaagaguggauccaacaucuuuaccaagagucggccccuucacaaucagauguggcauugauuagguuuacaaauccagacacaggacguguucuauuugaagcaaaauuacacaggagugguuacauuacaguggccaauacugguagcagaccaauuguggugccagcuaaugguuacuucagguuugacucuuggguuaaucaauucuauucucucgcccccaugggaacuggaaaugggcgcaggagggugcaauaa

SEQ ID NO: 5306 - RNA, 1623 nt, Artificial Sequence
  VP1__Norovirus__AII73774
augaagauggcgucgaaugacgcagcuccaucuaaugauggugcagcaggccucguaccagagaucaacaaugaggucaugccccuugagcccguggcuggugcaucgcuggcgacaccaguugucgggcaacaaaauauaauugaucccuggauaagaaauaauuuuguacaagcuccugcaggugaguuuacaguuuccccuagaaauuccccuggugaaauuuugcuugauuuggaguuggggccagaacugaaccccuaucucgcucaucuggcccguauguacaaugggcacgcugguggcauggaagugcaaauuguguuggcugggaacgcguucacagcuggcaagaucauauuugcugccaucccuccaggguucccauaugaaaauuugucgccuucacaaaucacaaugugcccucauguuauaauugauguuagacaauuagaaccaguucuacuaccuaugccagauauuagaaacaacuucuuccauuacaaucagggcaaugauccaaaauugagacugauagcuaugcucuacaccccuuuaagggcuaacaauucuggugaugauguguucacaguuucuuguaggguccucacuaaaccgucaccugauuuugaguucacauuuuugguccccccuacgguugaaucuaagaccaaacaguucacauugcccauccucaaaauaucagagaugaccaacucaagauucccagugccaguggaaaugauguacacagccaggaaugagaaccaaguuguccagccacagaaugguagggucacacuugauggcgagcuauuagguaccacacccuuguuggcugucaacaucugcaaauucaagggggaggucauagcuaagaauggagaugugagauccuauaggauggauauggaaauuaccaacacugauggcaccccaauugaccccacagaagacacaccuggucccauugguucaccugacuuucaagguauacucuuuggcguugccagccaacgcaacaagaaugagcaaaacccugccacgagagcccaugaagccaacauuaacacugguggggaccaauacgcccccaaauuggcccaagugaaauucuucucagagucccaggauuucgaggugcaccagcccacaguuuucaccccaguugguguggcaggcgacacuucccacccuuucagacaguggguccugccucgauacgguggacaucucaccaacaacacccacuuggcuccagcaguggcccccuuauucccaggugagcagauucuguucuuuagaucacaaauacccagcucaggcggccaugaauuggguuacauggacugccuugucccacaagaauggguccaacacuucuaucaagaagcugccacagcucagucugagguggcacucauaagguucaucaacccagacacuggcagaguccucuuugaggccaagcugcacaagcaaggcuuuauaacuguggcucacacuggugauaacccaauugucaugccaccaaauggguacuuuagauuugaagccuggguuaaucaguuuuacucacucgcccccgugggaacugggaaugggcgcaggaggauccaauaa

SEQ ID NO: 5307 - RNA, 1623 nt, Artificial Sequence
  VP1__Norovirus__AII73777
augaagauggcgucgagugacgccaacccaucugauggguccgcagccaaccucgucccagaggucaacaaugagguuauggcucuggagcccguuguuggugccgccauugcggcgccuguagcgggccaacaaaauguaauugaccccuggauuagaaauaauuuuguacaggccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuucccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccagucggugucauccaagaugguggcaccacccaccgaaaugaaccccagcagugggugcucccaaguuacucaggcagaaacacucauaaugugcaucuggcccccgcuguagcccccacuuuuccgggugagcaacuucucuucuucagguccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaauaugauuugguuauuccccccaaugguuauuuuagguuugauuccugggucaaccaguuuuacacgcuugcccccaugggaaauggaacggggcguagacgugcaguauaa

SEQ ID NO: 5308 - RNA, 1611 nt, Artificial Sequence
  VP1__Norovirus__AII73780
augaagauggcgucgaaugacgcuacuccaucugaugauggugcagccggccucguaccagagaucaacagugagguuauggcucuugaacccgucgcuggggccuccauugcagcccccguagucggccaacagaauauaauugaucccuggauuagaaauaauuuuguacaagccccugcuggugaauucacaguuuccccuagaaacucuccuggagaacuucuacuugauuuggaauuggguccugaacuuaaucccuaucuugcacauuuggccaggauguacaaugggcacgcaggaggaauggaagugcagauaguacuggcugggaaugcguucacagcugguaaaauccuauuugcugccaucccgccuagcuuucccuaugaaaaucugucacccgcucaauugacuaugugcccccaugugauaguggaugugagacaauuagaaccagugcuucugccaaugccagauauaagaaauguuuucuaucacuauaaccagaacaauagucccaaacuuaggcuuguagcuaugcuuuauacuccucugagggcuaacaacucaggugaugacguguucacggugucuugccgcguuuuaacacguccuucuccagauuuccaguucaccuuucuggucccaccuacaguugagucuaaaacuaagaauuucacccuucccguucuuagagucucagagaugacaaauucaagguuccccguuguuuuggaccaaauguauacaagcaggaaugaaaacaccauuguccaaccccaaaacggcaggugcacgacugacggugagcugcuuggcacuaccaucuugcagucugugucuauuugcaauuuuaaaggaacaaugcaggcaaagcugaaugaagaaccacgauaccaguuacaacucaccaacuuggaugggucacccauagauccaacagaugauaugccugccccucuuggcacaccagauuuccaggccguguuauauggcguugcaagccaacgcucuuccagagacaaugccaccagggcacaugaugcacagauugacacugcgggugacacauucgccccgaaaauuggccagguucguuuuaaaucaagcucuaaugauuuugaccuacaugacccuacaaaauucacaccuauugguguuaauguggaugaucagcacccuuuuagacaguggucccuaccaaacuacgguggucaccuugcccugaacaaucauuuggcccccgcugugacaccacucuuuccuggcgagcagauuuuguucuucaggucauacauuccaagcgccggaggccacacagauggugcuauggacugcuugcugccccaagaguggguggagcacuucuaccaggaagcugccccuucccaaucugacaucgcacugguaagguucauuaacccugacacaggaagagugcucuuugaagcuaaauugcauaaacaagguuuccucacaauugcagcaucuggagaucacccuauugugaugcccacuaaugguuacuuuagguuugaagcuugggucaacccuuucuauacucucgcccccgugggaacugggucugggcgcaggaggauucaauaa

SEQ ID NO: 5309 - RNA, 1632 nt, Artificial Sequence
  VP1__Norovirus__AII73783
augaugauggcgucuaaggacgccccaacaaacauggauggcaccaguggugccggucagcugguaccagaggcaaauacagcugaaccuuuaccaauaaaaccaguggccggggcugcgacugcgguugcaaccgccggucagguaaauaugauugaccccuggauaaugaauaauuuuguacaggcuccccaaggggaguuuaccauuuccccaaauaauacaccuggugauauuuuauuugauuugcaauuaggaccacaucuuaauccuuucuuggcucauuugucuagaauguacaauggcuggguugggaauaugcagguccgcauaaugcuugcugguaaugccuuuucagcuggaaagauuauugugugcugcauaccgccggguuuuucuucucaaucuauuucuauugcucaagcuacaauguucccacaugucauagcugauguuagaguguuagaaccuauugauguacccuuagaugauguuagaaauguccuuuuucauaauaaugauaacccccaaacgaugagauugcuuugcauguuguauacaccccuucggucuggugguacaucuucagguacagauccuuuugucauugcuggucgugucuugaccugccccacaccugauuuuaguuucuuguuccuugucccuccugauaucgagcaaagaacuaagccauucaguguacccaauaucccuaugaaccugauguccaauucccguguuucaauguugauugaugguaugaugguuucaaaugaucagaaucaagucccccaguuucagaauggucgagucacuuuagauggacagcugcaggguaccaccacaguuucagcugcguguguagcaaggaugaggggacgcauuuuuaauaauaauggcaauuauggugugaaccugacugaacuggauggcaauccuuaucaugccuuugauagcccggcuccuuuaggcuuuccugacuuugggaauugugauuugcacaugaccuuuguuaaaauuaaccccaaugaguuguccucuggagacccuucuggcaaaguggucauucauuccuacgaugccacuuuugccccccaucuugguacugucaaacuggagaaugaugaugagcuagcucgguuuguggguaaggagguaguacuggagcugacguggguuuccaacagagagggugccacccuuaaucuaugggcuguuccaaauuaugguuccaguuugacacaggcgucacagcuugccccaccaauuuaccccccuggguuuggugaggcuauuguguauuucaccucuacuuuuccaacagucagcaacccaaaagucccauguacacuuccucaagaauuuguuucacauuuugucaaugaacaggcccccacacgcggcgaugccgcucuucuucauuauguugauccugacacacaucguaaucuuggagaguuuaagauguacccugagggcuacaugacaugugucccuaaugcugguggugggccacaaaccuuaccaaucaaugguguauuugucuucauuucuuggguuucuagauauuaccaguuaaagccugugggaacugccggugcggcuaggaggcuuggucuuaggagaucauaa

SEQ ID NO: 5310 - RNA, 1608 nt, Artificial Sequence
  VP1__Norovirus__AII73786
augaagauggcgucgagugacgccgcuccaucuaaugauggugcagccggucuuguaccagaggcuaacaaugagaccauggcacuugaaccgguggcuggggcuucaauagccgccccacucaccggccaaaacaauauuauagaccccuggauuagauuaaauuuugugcaggcucccaauggagaguucacgguuucaccccgcaacucgcccggggaaguccuauuaaauuuggaauuaggccccgaacuaaauccauaccuagcacaccuuucuagaauguauaaugguuaugcgggugggguugaggugcaaguacuacuggcugggaaugcguucacagcuggaaaacugguguuugccgcaguucccccucauuuuccauuagaaaauauaagcccuggccagauaacuauguucccucauguaauuauugauguuaggacuuuagaaccaguuuuguugccccuuccugauguuaggaauaacuucuuucauuauaaucagcagaaugaaccgaggaugagacuuguagcaaugcuuuauacuccucuuagaucuaaugguucuggugaugauguauucacugucuccugcagggugcucacccgaccuuccccugauuuugauuuuaauuauuugguccccccuacuguugaaucuaaaaccaaacccuucacacucccuaucuugacuauaggggaguuaaccaacuccagguucccugugccuauagaugagcucuacaccagucccaaugagagucugguggugcaaccccagaacgggagaugcgcacuagauggggagcugcagggcacgacucagcuccuccccacggcgaucugcucguucaggggccggaucaaucagaaggugaguggggaaaaccacguuuggaauaugcaggucaccaacauuaacgggaccccuuuugauccaacagaggaugucccggcuccucuaggcaccccagauuucucuggcaagcucuuugguguacuaagccagagagaccaugauaaugccugcaggagucaugaugcaguaauugcaaccaacucugccaaauucaccccaaaauugggcgcuauacaaauuggcacaugggaagaaaacgaugugcacaucaaccaaccuacuaaguuuacuccaguuggcuuguuugaagaugaagguuucaaccaguggacacuccccaauuauucuggagccuuaacacuuaauaugggguuggccccuccuguggcccccaccuucccuggugaacaaauucuuuucuuuagaucccacauuccucuuaaaggagguguggcggacccaguuauugauugucucuugccucaagaauggauccaacaucuuuaccaagagucggcccccucacaaucagauguagcacugauuagguuuacaaauccagacacaggacguguucuauuugaagcaaaauuacacaggagugguuacaucacaguggccaauacugguagcagaccgauugucguaccagcuaaugguuacuucagguuugacucuuggguuaaucaauucuauucucucgcccccaugggaacuggaaaugggcgcagaagggugcaauaa

SEQ ID NO: 5311 - RNA, 1623 nt, Artificial Sequence
  VP1__Norovirus__AIS40019
augaagauggcgucgagugacgccaacccaucugauggguccgcagccaaccucgucccagaggucaauaaugagguuauggcucuggagcccguuguuggugccgccauugcggcaccuguagcgggccaacaaaauguaauugaccccuggauuagaaauaauuuuguaccagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguacacaccacuuagggcuaacaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcgccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguaggcgugcacuauaa

SEQ ID NO: 5312 - RNA, 1623 nt, Artificial Sequence
  VP1__Norovirus__AIV43147
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccagguuacuauguucccccauauaguaguagauguuaggcaauuagaaccuguguugauucccuuacccgauguuaggaauaauuucuaucauuacaaucaaucaaaugaccccaccauuaaguugauagcaauguuguacacaccacuuagggcuaauaaugcuggggaugaugucuucacagucucuugccgaguucucacgagaccaucccccgauuuugauuucauauuucuagugccacccacaguugagucaagaacuaaaccauucucugucccaguuuuaacuguugaggaaaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcacauucagaggggaugucacccauaucacagguagucguaacuacacaaugaauuuggcuucucaaaauuggagcaauuaugauccaacagaagaaaucccagccccucuaggaacuccagacuuuguggggaagauucaaggcgugcucacccaaaccacaaggacagauggcucaacacgcggccacaaagccacaguguacacugggagcgccgauuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcaguggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5313 - RNA, 1623 nt, Artificial Sequence
  VP1__Norovirus__AIV43148
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaauuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacuguccccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaacuacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccuggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5314 - RNA, 1623 nt, Artificial Sequence
  VP1__Norovirus__AIV43149
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaauuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaacuacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccuggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5315 - RNA, 1623 nt, Artificial Sequence
  VP1__Norovirus__AIV43150
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggcuagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugacuccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcacuuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguauuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5316 - RNA, 1623 nt, Artificial Sequence
  VP1__Norovirus__AIV43151
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguucacaguauccccuagaaacgcuccaggugaaauacuauggagcgcgccccugggcccugaucuaaaucccuaccuaucccauuuggccagaauguacaaugguuaugcaggugguuuugaagugcagguaauucucgcggggaacgcguucaccgccgggaagaucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuuccugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucagggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucuguuaagauuugugaauccagacacagguaggguuuuguuugaguguaagcuucauaaaucaggcuauguuacaguggcucacacuggccaacaugauuugguuauuccccccaaugguuauuuuagguuugauuccugggucaaccaguuuuacacgcuugcccccaugggaaauggaacggggcguagacgugcacuauaa

SEQ ID NO: 5317 - RNA, 1623 nt, Artificial Sequence
  VP1__Norovirus__AIV43152
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauccuugcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggagugggugcaguacuucuaccaagaggcagccccagcacaaucugauguggcucugcuaagauuugugaauccagacacagguaggguuuuguuugaguguaagcuucauaaaucaggcuauguuacaguggcucacacuggucaacaugauuugguuaucccccccaaugguuauuuuagguuugauuccugggucaaccaguuuuacacgcuugcccccaugggaaauggaacggggcguagacgugcacuauaa

SEQ ID NO: 5318 - RNA, 1623 nt, Artificial Sequence
  VP1__Norovirus__AIV43153
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccagucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacugggcagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaacggaacggggcguagacgugcacuauaa

SEQ ID NO: 5319 - RNA, 1623 nt, Artificial Sequence
  VP1__Norovirus__AIV43154
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccagucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacugggcagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5320 - RNA, 1623 nt, Artificial Sequence
  VP1__Norovirus__AIV43155
augaagauggcgucgagugacgccaacccaucugauggguccgcagccaaccucgucccagaggucaacaaugagguuauggcuuuggagcccguuguuggugccgccauugcggcaccuguagcgggccaacaaaauguaauugaccccuggauuaggaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagguccaccaugcccgguugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5321 - RNA, 1623 nt, Artificial Sequence
  VP1__Norovirus__AIV43156
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucgcgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccagucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaagacagauggcucaacacgcggccauaaagccacaguguacacugggagcgccgacuuugcuccaaaacuggguagaguucaauuugaaacugacacagaccaugauuuugaagcuaaucaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5322 - RNA, 1623 nt, Artificial Sequence
  VP1__Norovirus__AIV43159
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucgcgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccagucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccauaaagccacaguguacacugggagcgccgacuuugcuccaaaacuggguagaguucaauuugaaacugacacagaccaugauuuugaagcuaaucaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5323 - RNA, 1623 nt, Artificial Sequence
  VP1__Norovirus__AIV43160
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuugcccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauucccuuggaaaaguuguucacgggucccagcagugccuuuguuguccaaccacaaaacgguaggugcacgacugauggcgugcuccuaggcaccacccaacugucuccugucaacaucugcaccuucagaggagaugucauccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaacgugcaucuggcccccgcuguagcccccacuuuuccgggugagcaacuucucuuuuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5324 - RNA, 1623 nt, Artificial Sequence
  VP1__Norovirus__AIV43161
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauucccuuggaaaaguuguucacgggucccagcagugccuuuguuguccaaccacaaaacgguaggugcacgacugauggcgugcuccuaggcaccacccaacugucuccugucaacaucugcaccuucagaggagaugucauccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaacgugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5325 - RNA, 1623 nt, Artificial Sequence
  VP1__Norovirus__AIV43162
augaagauggcgucgagugacgccaacccaucugauggguccgcagccaaccucgucccagaggucaacaaugagguuauggcuuuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuccuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucugggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccgguugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5326 - RNA, 1623 nt, Artificial Sequence; identical to SEQ ID NO: 5325
  VP1__Norovirus__AIV43163

SEQ ID NO: 5327 - RNA, 1623 nt, Artificial Sequence; identical to SEQ ID NO: 5323
  VP1__Norovirus__AIV43164

SEQ ID NO: 5328 - RNA, 1623 nt, Artificial Sequence
  VP1__Norovirus__AIV43165
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaguaauuuuguacaagccccugguggagaguuuacaguauccccuagaaacgcuccaggugaaauauuauggagcgcgcccuugggcccugaucuaaaucccuaccuaucccauuuggccagaauguacaaugguuaugcagguggcuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagacuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacucccaaugugcaucuggcccccgcuguagcccccacuuuuccgggugagcaacuucucuucuucagauccaccaugcccggaugcagcggguaccccaacauggacuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugacuccuggguuaaccaguuuuacacgcuugcccccaugggaaauggaacggggcguagacgugcacuauaa

SEQ ID NO: 5329 - RNA, 1623 nt, Artificial Sequence
  VP1__Norovirus__AIV43166
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuuaaaucccuaccuaucccauuuggccagaauguacaaugguuaugcaggugguuuugaagugcagguaauucucgcggggaacgcguucaccgccgggaagguuauauuugcagcaguuccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaaccaaaccauucucugucccaauuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5330 - RNA, 1623 nt, Artificial Sequence
  VP1__Norovirus__AIV43167
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccauccccugauuuugacuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuugugggaaagauucaaggcgugcucacccaaaccacaaggacagauggcucaacacgcggccacaaagccacaguguacacugggagcgcugacuuugcuccaaaauuggguagaguucaauuugaaacugacacagaccaugauuuugaaacuaaccaaaacacaaaguucaccccaguuggugucauccaagaugguagcaccacccaccgaaaugaaccccaacagugggugcucccaaguuacucaggcagaaauacuccuaaugugcaucuggcccccgcuguggcccccacuuuuccgggugagcaacuucucuucuucagauccaccaugcccggaugcagcggguaccccaacauggauuuggacugucuacucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5331 - RNA, 1623 nt, Artificial Sequence
  VP1__Norovirus__AIV43171
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccaucuggccagaauguacaacgguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgaugucaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccagucuuaacuguugaggagaugaccaauucaagauuccccauuccuuuggaaaagcuguucacgggucccagcagugccuuuguuguccaaccacaaaacggcaggugcacgacugauggcgugcuccuaggcaccacccaacugucuccugucaacaucugcaccuucagaggagaugucacccauaucacaggcagucauaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgauuuugcuccaaaacuggguagaguucaauuugaaacugacacaaaccaugauuuugaagcuaaccaaaacacaaaauucaccccaguuggugucauccaagacgguggcaccacccaccgaaaugaaccccaacagugggugcucccaaguuacucaggcagaaauacuccuaaugugcaucuggcccccgcuguagcccccaccuuuccgggugagcaacuucucuucuucagauccaccaugcccggauguagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5332 - RNA, 1623 nt, Artificial Sequence
  VP1__Norovirus__AIV43172
augaagauggcgucgagugacgccaacccaucugauggguccgcagccaaccucgucccagaggucaacaaugagguuauggcucuggagcccguuguaggugccgccauugcggcgccuguagcgggccaacaaaauguaauugaccccuggauuagaaauaauuuuguacaagccccugguggagaguucacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccacauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggagaaguuguucacgggucccagcagcgccuuuguuguccaaccacaaaacgguaggugcacgacugauggcgugcuccuaggcaccacccaacugucuccuguuaacaucugcaccuucagaggagaugucacccauaucacagguagucguaacuacacaaugaauuuggcuucucagaauuggagcaauuaugacccaacagaagaaaucccagccccucuaggaacuccagauuuuguggggaagauccaaggcaugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggccccugcuguagcccccacuuuuccgggugagcaacuucucuucuucagauccaccaugcccggaugcagcggguaccccaacauggauuuggacugucuacucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaauggcuauuuuagguuugauuccugggucaaccaguuuuacacgcuugcccccaugggaaauggaacggggcguagacgugcacuauaa

SEQ ID NO: 5333 - RNA, 1623 nt, Artificial Sequence
  VP1__Norovirus__AIV43173
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaccccuaccuaucccauuuggcuagaauguacaaugguuaugcaggugguuuugaagugcagguaauucucgcggggaaugcguucaccgccgggaaggucauauuugcagcagucccaccaaauuuuccaacugaaggcuugagccccagccaggucacuauguuuccccauauaguaguagauguuaggcaacuagaaccuguguugauucccuuacccgauguuaggaauaauuucuaucauuacaaucaaucaaaugaccccaccauuaaguugauagcaauguuguacacaccacuuagggcuaauaaugcuggggaugaugucuuuacaguuucuugccgaguucucacgagaccaucccccgauuuugauuuuauauuucuagugccacccacaguugagucaaggacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaauaucugcaccuucagaggagaugucacccauaucacagguagucauaacuauacaaugaauuuggcuucucaaaauuggaacaauuaugacccaacagaagaaaucccagccccucuaggaacuccagauuuuguggggaagauucaaggcgugcucacucaaaccacaaggacagauggcucaacacgcggccacaaagcuacaguguacacugggagcgccgauuuugcuccaaaacuggguagaauucaauuugaaacugacacaaaccaugauuuugaagcuaaccaaaacacaaaguucaccccaguuggugucauccaagaugguggcaccacccaccgaaaugaaccccaacagugggugcucccaaguuacucgggcagaaauacuccuaaugugcaucuggcccccgcuguggcccccacuuuuccgggugagcagcuucucuuuuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggucaacaugauuugguuaucccccccaaugguuauuuuagguuugauuccugggucaaucaguuuuacacgcuugcccccaugggaaacggaacggggcguagacgugcacuauaa

SEQ ID NO: 5334 - RNA, 1623 nt, Artificial Sequence
  VP1__Norovirus__AIV43174
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuuggguccugaucuaaaucccuaccuaucccaucuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguccucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacaggcagucgaaacuacacaaugaauuuggcuucucaaaauuggaacaauuaugacccaacagaagaaaucccagccccucuagggacuccagauuuuguggggaagauucaaggcgugcucacccaaaccacaaggacagauggcucaacacgcggccacaaagcuacaguguacacugggagcgccgauuucucuccaaaacuggguagaguucaauuugaaacugauacagaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugccugcucccccaggaaugggugcaguacuucuaccaagaggcagccccagcacaaucugauguggcucugcuaagauuugugaauccagacacagguaggguuuuguuugaguguaagcuccauaaaucaggcuauguuacaguggcucacacuggccaacaugauuugguuaucccccccaaugguuauuuuagguuugauuccugggucaaccaguuuuacacgcuugcccccaugggaaauggaacggggcguaggcgugcacuauaa

SEQ ID NO: 5335 - RNA, 1623 nt, Artificial Sequence
  VP1__Norovirus__AIV43175
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuuggguccugaucuaaaucccuaccuaucccaucuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguccucacgagaccaucccccgauuuugauuucauauuucuagugccacccacaguugagucaagaacuaaaccauucucugucccaguucuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacaggcagucgaaauuacacaaugaauuuggcuucucaaaauuggaacaauuaugacccaacagaagaaaucccagccccucuagggacuccagauuuuguggggaagauucaaggcgugcucacccaaaccacaaggacagauggcucaacacgcggccacaaagcuacaguguacacugggagcgccgauuuuucuccaaaacuggguagaguucaauuugaaacugauacagaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccgggugcagcggguaccccaacauggauuuggacugccugcucccccaggaaugggugcaguacuucuaccaagaggcagccccagcacaaucugauguggcucugcuaagauuugugaauccagacacagguaggguuuuguuugaguguaagcuccauaaaucaggcuauguuacaguggcucacacuggccaacaugauuugguuaucccccccaaugguuauuuuagguuugauuccugggucaaccaguuuuacacgcucgcccccaugggaaauggaacggggcguaggcgugcacuauaa

SEQ ID NO: 5336 - RNA, 1623 nt, Artificial Sequence
  VP1__Norovirus__AIV43176
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuucccaacugaaggcuugagccccagccaggucacuauguucccccauauaguaguagauguuaggcaacuagaaccuguguugauucccuuacccgauguuaggaauaauuucuaucauuacaaucaaucaaaugaccccacuauuaaguugauagcaauguuguauacaccacuuagggcuaauaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggcgucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5337 - RNA, 1623 nt, Artificial Sequence
  VP1__Norovirus__AIV43177
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaccccuaccuaucccauuuggccagaauguacaaugguuaugcagguggcuuugaagugcagguaauucucgcggggaacgcguucaccgccgggaaagucauauuugcagcagucccaccaaauuuuccaacugaaggcuugagccccagccaggucacuauguucccccauauaguaguagauguuaggcaauuagaaccuguguugauucccuuacccgacguuaggaauaauuucuaucacuacaaucaaucaaaugaccccaccauuaaguugauagcaauguuguauacaccacuuagggcuaauaaugcuggggaugaugucuucacaguuucuugccgaguucucacgaggccaucccccgauuuugauuucauauuucuagugccacccacaguugagucaagaacuaaaccauucucugucccaguuuuaacuguugaggagaugaccaauucaagauuccccaucccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagacuuuguggggaagauucaaggcgugcucacccaaaccacaaggacagauggcucaacacgcggccacaaagccacaguguacacugggagcgcugacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcuuccaaguuacucaggcagaaacacuccuaaugugcaucuggcccccgcuguagcccccacuuuuccgggugagcaacuucucuucuucagauccaccaugcccggaugcagcggguaccccaacauggacuuggacugccugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5338 - RNA, 1623 nt, Artificial Sequence
  VP1__Norovirus__AIV43178
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaucccaccauuaaguugauagcaauguuguacacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugacggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcaugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5339 - RNA, 1623 nt, Artificial Sequence
  VP1__Norovirus__AIV43179
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucaccauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucgcaacuacacaaugaauuuggcuucucaaaauuggagcaauuaugacccaacagaagauaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguggcaccacccaccgaaaugaaccccaacaguggguacucccaaguuacucaggcagaaauacuccuaaugugcaucuagcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5340 - RNA, 1623 nt, Artificial Sequence
  VP1__Norovirus__AIY27747
augaagauggcgucgaaugacgccaacccaucugauggguccgcagccaaccucgucccagaggucaacaaugagguuauggcucuggagcccguuguuggugccgccauugcggcaccuguagcgggccagcaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaaccaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacgaggacagauggcucaacacguggccacaaagcuacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggccccugcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5341 - RNA, 1623 nt, Artificial Sequence
  VP1__Norovirus__AJA71387
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuuggguccugaucuaaaucccuaccuaucccaucuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguccucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccacaucacaggcagucgaaacuacacaaugaauuuggcuucucaaaauuggaacaauuaugacccaacagaagaaaucccagccccucuagggacuccagauuuuguggggaagauucaaggcgugcucacccaaaccacaaggacagauggcucaacacgcggccacaaagcuacaguguacacugggagcgccgauuucucuccaaaacuggguagaguucaauuugaaacugauacagaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugccugcucccccaggaaugggugcaguacuucuaccaagaggcagccccagcacaaucugauguggcucugcuaagauuugugaauccagacacagguaggguuuuguuugaguguaagcuccauaaaucaggcuauguuacaguggcucacacuggccaacaugauuugguuaucccccccaaugguuauuuuagguuugauuccugggucaaccaguuuuacacgcuugcccccaugggaaauggaacggggcguaggcgugcacuauaa

SEQ ID NO: 5342 - RNA, 1623 nt, Artificial Sequence
  VP1__Norovirus__AJA71388
augaagauggcgucgagugacgccaacccaucugauggguccgcagccaaccucgucccagaggucaacaaugagguuuuggcuuuggagcccguuguuggugccgccauugcggcaccuguagcgggccaacaaaauguaauugaccccuggauuaggaauaauuuuguacaagccccugguggagaguuuacaguauccccuagaaacgcuccaggugaaauacuauggagcgcgcccuugggcccugaucuaaaucccuaccuaucccaucuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuuuauauuucuagugccacccacaguugagucaagaacuaaaccauucucugucccaauuuuaacuguugaggagaugaccaauucaagauuccccauuccuuuggaaaagcuguucacgggucccagcagugccuuuguuguccaaccacaaaacgguaggugcacgacugauggcgugcuccuaggcaccacccaacugucuccugucaacaucugcaccuucagaggagaugucacccauaucacagguagucauaacuacacaaugaauuuggcuucucaaaauuggagcaauuaugauccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccgguugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuacguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5343 - RNA, 1623 nt, Artificial Sequence
  VP1__Norovirus__AJA71389
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguuuccccauauaguaguagauguuaggcaauuagaaccuguguugauucccuuacccgauguuaggaauaauuucuaucauuacaaucaaucaaaugaucccaccauuaaguugauagcaauguuguacacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugacggugugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcaugcucacccaaaccacaaggacagauggcucaacacgcggccacaaagccacaguguauacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5344 - RNA, 1623 nt, Artificial Sequence
  VP1__Norovirus__AJA71390
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaccccuaccuaucccauuuggccagaauguacaaugguuaugcagguggcuuugaagugcagguaauucucgcggggaacgcguucaccgccgggaaagucauauuugcagcagucccaccaaauuuuccaacugaaggcuugagccccagccaggucacuauguucccccauauaguaguagauguuaggcaauuagaaccuguguugauucccuuacccgacguuaggaauaauuucuaucauuacaaucaaucaaaugaccccaccauuaaguugauagcaauguuguauacaccacuuagggcuaauaaugcuggggaugaugucuucacaguuucuugccgaguucucacgaggccaucccccgauuuugauuucauauuucuagugccacccacaguugagucaagaacuaaaccauucucugucccaguuuuaacuguugaggagaugaccaauucaagauuccccaucccuuuggaaaaguuguucacgggucccagcagugccuuuguuguccaaccacaaaacgguaggugcacgacugauggcuugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagacuuuguagggaagauucaaggcgugcucacccaaaccacaaggacagauggcucaacacgcggccacaaagccacaguguacacugggagcgcugacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcuuccaaguuacucaggcagaaauacuccuaaugugcaucuggcccccgcuguagcccccacuuuuccgggugagcaacuucucuucuucagauccaccaugcccggaugcagcggguaccccaacauggacuuggacugccugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggucaacaugauuugguuaucccccccaaugguuauuuuagguuugauuccugggucaaccaguucuacacgcuugcccccaugggaaauggaacggggcguagacgugcacuauaa

SEQ ID NO: 5345 - RNA, 1623 nt, Artificial Sequence
  VP1__Norovirus__AJA71392
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguuuaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuuuagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5346 - RNA, 1623 nt, Artificial Sequence; identical to SEQ ID NO: 5314
  VP1__Norovirus__AJA71393

SEQ ID NO: 5347 - RNA, 1623 nt, Artificial Sequence
  VP1__Norovirus__AJA71394
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguucacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacgguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacaacugauggcgugcuccuaggcaccacccaacugucucccgucaacaucugcaccuucagaggagaugucacccauaucacagguagucauaacuacacaaugaauuuggcuucucaaaauuggagcaauuacgacccaacagaagaaaucccagccccucuaggaacuccagacuuuguggggaagauucaaggcgugcucacccaaaccacaaggacagauggcucaacacgcggccacaaagccacaguguacauugggagcgccgacuuugcuccaaaacugggcagaguucaauuugaaacugacacaaaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggcgagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaauguaagcuucauaaaucaggcuauguuacaguggcucacaccggccaacaugauuugguuaucccccccaaugguuauuuuagguuugauuccagggucaaccaguuuuacacgcuugcccccaugggaaauggaacggggcguagacgugcacuauaa

SEQ ID NO: 5348 - RNA, 1623 nt, Artificial Sequence
  VP1__Norovirus__AJA71395
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaccccuaccuaucccauuuggccagaauguacaaugguuaugcagguggcuuugaagugcagguaauucucgcggggaacgcguucaccgccgggaaagucauauuugcagcagucccaccaaauuuuccaacugaaggcuugagccccagccaggucacuauguucccccauauaguaguagauguuaggcaauuagaaccuguguugauucccuuacccgacguuaggaauaauuucuaucauuacaaucaaucaaaugaccccaccauuaaguugauagcaauguuguauacaccacuuagggcuaauaaugcuggggaugaugucuucacaguuucuugccgaguucucacgaggccaucccccgauuuugauuuuauauuucuagugccacccacaguugagucaagaacuaaaccauucucugucccaguuuuaacuguugaggaaaugaccaauucaagauuccccaucccucuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaauuccagccccucuaggaacuccagacuuuguggggaagauucaaggcgugcucacccaaaccacaaggacagauggcucaacacgcggccacaaagccacaguguacacugggagcgcugacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcuuccaaguuacucaggcagaaacacuccuaaugugcaucuggcccccgcuguagcccccacuuuuccgggugagcaacuucucuucuucagauccaccaugcccggaugcagcggguaccccaacauggacuuggacugccugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaacggaacggggcguagacgugcacuauaa

SEQ ID NO: 5349 - RNA, 1623 nt, Artificial Sequence
  VP1__Norovirus__AJA71396
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguuaauucccuuacccgauguuaggaauaauuucuaucauuacaaucaaucaaaugaucccaccauuaaguugauagcaauguuguacacaccacuuagggcuaauaaugcuggggaugaugucuucacaguuucuugccgaguucucacgagaccaucccccgauuuugauuucauauuccuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugacggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcaugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaggaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggacuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcuuacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5350 - RNA, 1623 nt, Artificial Sequence
  VP1__Norovirus__AJA71399
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaccccuaccuaucccauuuggccagaauguacaaugguuaugcagguggcuuugaagugcaaguaauucucgcggggaacgcguucaccgccgggaaagucauauuugcagcagucccaccaaauuuuccaacugaaggcuugagccccagccaggucacuauguucccccauauagcaguagauguuaggcaauuagaaccuguguugauucccuuacccgacguuaggaauaauuucuaucauuacaaucaaucaaaugaccccaccauuaaguugauagcaauguuguauacaccacuuagggcuaauaaugcuggggaugaugucuucacaguuucuugccgaguucucacgaggccaucccccgauuuugauuucauauuucuagugccacccacaguugagucaagaacuaaaccauucucugucccaguuuuaacuguugaggagaugaccaauucaagauuccccaucccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagacuuuguggggaagauucaaggcgugcucacccaaaccacaaggacagauggcucaacacgcggccacaaagccacaguguacacugggagcgcugacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcuuccaaguuacucaggcagaaauacuccuaaugugcaucuggcccccgcuguagcccccacuuuuccgggugagcaacuucucuucuucagauccaccaugcccggaugcagcggguaccccaacauggacuuggacugccugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5351 - RNA, 1623 nt, Artificial Sequence
  VP1__Norovirus__AJA71400
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaccccuaccuaucccauuuggccagaauguacaaugguuaugcagguggcuuugaagugcagguaauucucgcggggaacgcguucaccgccgggaaagucauauuugcagcagucccaccaaauuuuccaacugaaggcuugagccccagccaggucacuauguucccccauauaguaguagauguuaggcaauuagaaccuguguugauucccuuacccgacguuaggaauaauuucuaucauuacaaucaaucaaaugaccccaccauuaaguugauagcaauguuguauacaccacuuagggcuaauaaugcuggggaugaugucuucacaguuucuugccgaguucucacgaggccaucccccgauuuugauuuuauauuucuagugccacccacaguugagucaagaacuaaaccauucucugucccaguuuuaacuguugaggagaugaccaauucaagauuccccaucccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagacuuuguggggaagauucaaggcgugcucacccaaaccacaaggacagauggcucaacacgcggccacaaagccacaguguacacugggagcgcugacuuugcuccaaaacuggguagaguucaauuugaaacugacacagaccgugauuuugaaacuaaccaaaacacaaaguucaccccaguuggugucauccaagaugguggcaccacccaccgaaaugaaccccaacagugggugcuuccaaguuacucaggcagaaauacuccuaaugugcaucuggcccccgcuguagcccccacuuuuccgggugagcaacuucucuucuucagauccaccaugcccggaugcagcggguaccccaacauggauuuggacugccugcucccccaggaaugggugcaguacuucuaccaagaggcagccccagcacaaucugauguggcucugcuaagauuugugaauccagacacagguaggguuuuguuugaguguaagcuccauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5352 - RNA, 1623 nt, Artificial Sequence
  VP1__Norovirus__AJA71401
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuuaaaccccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguuuccccauauaguaguagauguuaggcaacuagaaccuguguugauucccuuacccgauguuaggaauaacuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggaaaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcacuuucagaggagauaucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuuggaacugacacagaccaugauuuugaagcuaaccaaaacacaaaauucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuccacaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5353 - RNA, 1623 nt, Artificial Sequence
  VP1__Norovirus__AJA71402
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaccccuaccuaucccauuuggccagaauguacaaugguuaugcagguggcuuugaagugcaaguaauucucgcggggaacgcguucaccgccgggaaagucauauuugcagcagucccaccaaauuuuccaacugaaggcuugagccccagccaggucacuauguucccccauauaguaguagauguuaggcaauuagaaccuguguugauucccuuacccgacguuaggaauaauuucuaucauuacaaucaaucaaaugaccccaccauuaaguugauagcaauguuguauacaccacuuagggcuaauaaugcuggggaugaugucuucacaguuucuugccgaguucucacgaggccaucccccgauuuugauuucauauuucuagugccacccacaguugagucaagaacuaaaccauucucugucccaguuuuaacuguugaggagaugaccaauucaagauuccccaucccuuuggaaaagcuguucacgggucccagcagugccuuuguuguccaaccacaaaacgguaggugcacgacugauggcgugcuccuaggcaccacccaauugucuccugucaacaucugcaccuucagaggagaugucacccauaucacagguagucguaacuacacaaugaauuuggcuucucaaaauuggagcaauuaugacccaacagaagaaaucccagccccucuaggaacuccagacuuuguggggaagauucaaggcgugcucacccaaaccacaaggacagauggcucaacacgcggccacaaagccacaguguacacugggagcgcugacuuugcuccaaaacuggguagaguucaauuugaaacugacacagaccgugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggacuuggacugccugcucccccaggaaugggugcaguacuucuaccaagaggcagccccagcacaaucugauguggcucugcuaagauuugugaauccagacacagguaggguuuuguuugaguguaagcuucauaaaucaggcuaugucacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5354 - RNA, 1623 nt, Artificial Sequence
  VP1__Norovirus__AJA71403
augaagauggcgucgagugacgccaacccaucugauggguccgcagccaaccucgucccagaggucaacaaugagguuauggcucuggagcccguuguuggugccgccauugcagcaccuguagcgggccaacaaaauguaauugaccccuggauuagaaauaauuuuguacaagccccugguggagaguuuacaguauccccuagaaacgcuccaggugaaauacuauggagcgcgcccuuggguccugaucuaaaucccuaccuaucccaucuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguccucacgagaccaucccccgauuuugauuucauauuucuagugccacccacaauugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccacaucacaggcagucgaaacuacacaaugaauuuggcuucucaaaauuggaacaauuaugacccaacagaagaaaucccagccccucuagggacuccagauuuuguggggaagauucaaggcgugcucacccaaaccacaaggacagauggcucaacacgcggccacaaagcuacaguguacacugggagcgccgauuucucuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugccugcucccccaggaaugggugcaguacuucuaccaagaggcagccccagcacaaucugauguggcucugcuaagauuugugaauccagacacagguaggguuuuguuugaguguaagcuccauaaaucaggcuauguuacaguggcucacacuggccaacaugauuugguuaucccccccaaugguuauuuuagguuugauuccugggucaaccaguuuuacacgcuugcccccaugggaaauggaacggggcguaggcgugcacuauaa

SEQ ID NO: 5355 - RNA, 1623 nt, Artificial Sequence; identical to SEQ ID NO: 5351
  VP1__Norovirus__AJA71404

SEQ ID NO: 5356 - RNA, 1623 nt, Artificial Sequence
  VP1__Norovirus__AJA71405
augaagauggcgucgagugacgccaacccaucugauggguccgcagccaaccucgucccagaggucaacaaugagguuauggcucuggagcccguuguaggugccgccauugcggcaccuguagcgggccaacaaaauguaauugaccccuggauuagaaauaauuuuguacaagccccugguggagaguucacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaacaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuuuagaggagaugucacccauaucacagguagucguaacuacacaaugaauuuggcuucucaaaauuggaacaauuaugacccaacagaagaaaucccagccccucuaggaauuccagauuuuguggggaagauucaaggcaugcucacccaaaccacaaggacagauggcucaacacgcggccacaaagccacaguguacacugggagcgucgacuucgcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggccccugcuguagcccccacuuuuccgggugagcaacuucucuucuucagauccaccaugcccggaugcagcggguaccccaacauggauuuggacugucuacucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaauggcuauuuuagguuugauuccugggucaaccaguuuuacacgcuugcccccaugggaaauggaacggggcguagacgugcacuauaa

SEQ ID NO: 5357 - RNA, 1623 nt, Artificial Sequence
  VP1__Norovirus__AJA71406
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguguccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaacuuuccaacugaaggcuugagccccagccaggucacuauguucccccauauaguuguagauguuaggcaauuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuuuuaguaccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaauucaccccaguuggugucauccaagaugguagcaccacccaccgaaaugaaccccaacagugggugcucccaaguuacucaggcagaaacacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5358 - RNA, 1623 nt, Artificial Sequence
  VP1__Norovirus__AJA71407
augaagauggcgucgagugacgccaccccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaaugcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaauaacgcuggggacgaugucuucacaguuucuugccgaguucucacgagaccaucccccgauuuugauuucauauuucuagugccacccacaguugagucaaggacuaaaccauucucugucccaguuuuaacuguugaggagaugaccaauucaagauuccccauuccuuuggaaaaguuguucacgggucccaguagugccuucguuguccaaccacaaaacggcaggugcacgacugauggcgugcuccuaggcaccacccaacugucuccugucaacaucugcaccuucaggggagaugucacccauaucacagguagucauaacuacacaaugaauuuggcuucucaaaauuggaacaauuaugacccaacagaagaaaucccagccccucugggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacaaaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcccugcuaagauuugugaauccagacacagguaggguuuuguuugaguguaagcuucauaaaucaggcuauguuacaguggcucacacuggccaacaugauuugguuauccccccaaaugguuauuuuagguuugauuccugggucaaccaguuuuacacgcuugcccccaugggaaauggaacggggcguagacgugcaguauaa

SEQ ID NO: 5359 - RNA, 1623 nt, Artificial Sequence; identical to SEQ ID NO: 5354
  VP1__Norovirus__AJA71408

SEQ ID NO: 5360 - RNA, 1623 nt, Artificial Sequence; identical to SEQ ID NO: 5351
  VP1__Norovirus__AJA71409

SEQ ID NO: 5361 - RNA, 1623 nt, Artificial Sequence
  VP1__Norovirus__AJA71410
augaagauggcgucgagugacgccaacccaucugauggguccgcagccaaccucgucccagaggucaacaaugagguuauggcucuggagcccguuguuggugccgccauugcggcaccuguagcgggccaacaaaaugugauugaccccuggauuagaaauaauuuuguacaggccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauccucgcggggaacgcguucaccgccgggaaggucauauuugcagcagucccaccaaauuuuccaacugaaggcuugagccccagccaggucacuauguucccccauauaguaguagauguuaggcaacuagaaccuguguuaauucccuuacccgauguuaggaauaauuucuaucacuacaaucaaucaaaugaccccaccauuaaguugauagcaauguuguauacaccacuuagggccaauaaugcuggggaugauguuuucacaguuucuugccgaguucucacgagaccaucccccgauuuugauuucauauuucuagugccacccacaguugagucaagaacuaaaccauucucugucccagucuuaacuguugaagagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucauaauuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagauggcggcaccacccaccgaaaugaaccccaacagugggugcucccaaguuacucaggcagaaauacuccuaaugugcaucuggcccccgcuguagcccccacuuuuccgggcgagcaacuucucuucuucagauccaccaugcccggaugcagcggguaccccaacauggauuuggacugucugcucccccaggaaugggugcaguacuucuaccaagaggcagccccagcacaaucugauguggcucugcugagauuugugaacccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaacggaacggggcguagacgugcacuauaa

SEQ ID NO: 5362 - RNA, 1623 nt, Artificial Sequence
  VP1__Norovirus__AJA71411
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgccccugggcccugaucuaaaccccuaccuaucccauuuggccagaauguacaaugguuaugcagguggcuuugaagugcagguaauucucgcggggaacgcguucaccgccgggaaagucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgaggccaucccccgauuuugauuucauauuucuagugccacccacaguugagucaagaacuaaaccauucucugucccaguuuuaacuguugaggagaugaccaauucaagauuccccaucccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucugggaacuccagacuuuguggggaagauucaaggcgugcucacccaaaccacaaggacagauggcucaacacgcggccacaaagccacaguguacacugggagcgcugacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcuuccaaguuacucaggcagaaauacuccuaaugugcaucuggcccccgcuguagcccccacuuuuccgggugagcaacuucucuucuucagauccaccaugcccggaugcagcggguaccccaacauggauuuggacugccugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5363 - RNA, 1623 nt, Artificial Sequence
  VP1__Norovirus__AJA71412
augaagauggcgucgagugacgccaacccaucugauggguccgcagccaaccucgucccagaggucaacaaugagguuauggcucuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaccauuacaaucaaucaaaugaccccaccauuaaguugauagcaauguuguauacaccacuuagggcuaauaaugcuggggaugaugucuucacaguuucuugccgaguucucacgagaccaucccccgauuuugacuucauauuucuagugccacccacaguugagucaagaacuaaaccauucucugucccaguuuuaacugucgaggagaugaccaauucaagauuccccauucccuuggaaaaguuguucacgggucccagcagugccuuuguuguccaaccacaaaacgguaggugcacgacugauggcgugcuccuaggcaccacccaacugucuccugucaacaucuguaccuuuagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaacaggcuauguuacaguggcucauacuggccaacaugauuugguuaucccccccaaugguuauuucagguuugauuccugggucaaccaguuuuacacgcuugcccccaugggaaauggaacggggcguagacgugcacuauaa

SEQ ID NO: 5364 - RNA, 1623 nt, Artificial Sequence
  VP1__Norovirus__AJA71413
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaacuacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5365 - RNA, 1623 nt, Artificial Sequence
  VP1__Norovirus__AJA71416
augaagauggcgucgagugacgccaacccaucugauggguccgcagccaaccucgucccagaggucaacaaugaggucauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugauuuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacuaucuccugucaacaucugcaccuucagaggagaugucacccauaucacagguagucguaacuacacaaugaauuuggcuucucaaaauuggagcaacuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuguaa

SEQ ID NO: 5366 - RNA, 1623 nt, Artificial Sequence
  VP1__Norovirus__AJA71417
augaagauggcgucgagugacgccaacccaucugauggguccgcagccaaccucgucccagaggucaacaaugagguuauggcucuggagcccguuguaggugccgccauugcggcaccuguagcgggccaacaaaauguaauugaccccuggauuagaaauaauuuuguacaagccccugguggagaauucacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaagguuugagcccuagccaggucacuauguucccccauauaguaguagauguuaggcaacuagaaccuguguugauucccuuacccgauguuaggaauaauuucuaucauuacaaucaaucaaaugaccccaccauuaaauugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuugacuucucaaaauuggagcaauuaugacccaacagaagaaaucccagccccucuaggaacuccagauuuuguggggaagauucaaggcaugcucacccaaaccacaaggacagauggcucaacacgcggccacaaagccacaguguacacugggagcgccgauuuugcuccaaaacuggguagaguucaauuugaaacugacacagaccaugauuuugaagcuaaccaaaauacaaaguucaccccaguuggugucauccaagaugguagcaccacccaccgaaaugaaccccaacagugggugcucccaaguuacucaggcagaaauacuccuaaugugcaucuggccccugcuguagcccccacuuuuccgggugagcaacuucucuucuucagauccaccaugcccggaugcagcggguaccccaacauggauuuggacugucuacucccccaggagugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaauggcuauuuuagguuugauuccugggucaaccaguuuuacacgcuugcccccaugggaaauggaacggggcgcagacgugcacuauaa

SEQ ID NO: 5367 - RNA, 1623 nt, Artificial Sequence
  VP1__Norovirus__AJA71418
augaagauggcgucgagugacgccagcccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaccccuaccuaucccauuuggccagaauguacaaugguuaugcagguggcuuugaagugcagguaauucucgcggggaacgcguucaccgccgggaaagucauauuugcagcagucccaccaaauuuuccaacugaaggcuugagccccagccaggucacuauguucccccauauaguaguagauguuaggcaauuagaaccuguguugauucccuuacccgacguuaggaauaauuucuaucacuacaaucaaucaaaugaccccaccauuaaguugauagcaauguuguauacaccacuuagggcuaacaaugcuggggaugaugucuucacaguuucuugccgaguucucacgaggccaucccccgauuuugauuucauauuucuagugccacccacaguugagucaagaacuaaaccauucucugucccaguuuuaacuguugaggagaugaccaauucaagauuccccaucccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucgcaacuacacaaugaauuuggcuucucaaaauuggagcaauuaugacccaacagaagaaaucccagccccucuaggaacuccagacuuuguggggaagauucaaggcgugcucacccaaaccacaaggacagauggcucaacacgcggccacaaagccacaguguacacugggagcgcugacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcuuccaaguuacucaggcagaaauacuccuaaugugcaucuggcccccgcuguagcccccacuuuuccgggugagcaacuucucuucuucagauccaccaugcccggaugcagcggguaccccaacauggacuuggacugccugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5368 - RNA, 1623 nt, Artificial Sequence
  VP1__Norovirus__AJA71419
augaagauggcgucgagugacgccagcccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaccccuaccuaucccauuuggccagaauguacaaugguuaugcagguggcuuugaagugcagguaauucucgcggggaacgcguucaccgccgggaaagucauauuugcagcagucccaccaaauuuuccaacugaaggcuugagccccagccaggucacuauguucccccauauaguaguagauguuaggcaauuagaaccuguguugauucccuuacccgacguuaggaauaauuucuaucauuacaaucaaucaaaugaccccaccauuaaguugauagcaauguuguauacaccacuuagggcuaacaaugcuggggaugaugucuucacaguuucuugccgaguucucacgaggccaucccccgauuuugauuucauauuucuagugccacccacaguugagucaagaacuaaaccauucucugucccaguuuuaacuguugaggagaugaccaauucaagauuccccaucccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucgcaacuacacaaugaauuuggcuucucaaaauuggagcaauuaugacccaacagaagaaaucccagccccucuaggaacuccagacuuuguggggaagauucaaggcgugcucacccaaaccacaaggacagauggcucaacacgcggccacaaagccacaguguacacugggagcgcugacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcuuccaaguuacucaggcagaaauacuccuaaugugcaucuggcccccgcuguagcccccacuuuuccgggugagcaacuucucuucuucagauccaccaugcccggaugcagcggguaccccaacauggacuuggacugccugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5369 - RNA, 1623 nt, Artificial Sequence
  VP1__Norovirus__AJA71420
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccagguuacuauguucccccauauaguaguagauguuaggcaauuagaaccuguguugauucccuuacccgauguuaggaauaauuucuaucauuacaaucaaucaaaugaccccaccauuaaguugauagcaauguuguacacaccacuuagggcuaauaaugcuggggaugaugucuucacagucucuugccgaguucucacgagaccaucccccgauuuugauuucauauuucuagugccacccacaguugagucaagaacuaaaccauucucugucccaguuuuaacuguugaggaaaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcacauucagaggggaugucacccauaucacagguagucguaacuacacaaugaauuuggccucucaaaauuggagcaauuaugauccaacagaagaaaucccagccccucuaggaacuccagacuuuguggggaagauucaaggcgugcucacccaaaccacaaggacagauggcucaacacgcggccacaaagccacaguguacacugggagcgccgauuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcaguggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5370 - RNA, 1623 nt, Artificial Sequence
  VP1__Norovirus__AJA71421
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaucuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccagguuacuauguucccccauauaguaguagauguuaggcaauuagaaccuguguugauucccuuacccgauguuaggaacaauuucuaucauuacaaucaaucaaaugaccccaccauuaaguugauagcaauguuguauacgccacuuagggcuaauaacgcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccagcugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaggccacaguguacacugggagcgccgacuuugcuccaaaacuggguagaguucaauuugaaacugauacagaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggagagcaacuucucuucuucagauccaccaugcccggaugcagcggguaccccaacauggacuuggacugucugcucccccaggaaugggugcaguacuucuaucaggaggcagccccagcacaaucugauguggcucugcuaagauuugugaauccagacacagguaggguuuuguuugaguguaagcuccauaaaucaggcuauguuacaguggcucauacuggccaacaugauuugguuaucccccccaaugguuauuuuagguuugauuccugggucaaccaauuuuacacgcuugcccccaugggaaauggaacggggcguagacgugcacuauaa

SEQ ID NO: 5371 - RNA, 1623 nt, Artificial Sequence; identical to SEQ ID NO: 5354
  VP1__Norovirus__AJA71422

SEQ ID NO: 5372 - RNA, 1623 nt, Artificial Sequence
  VP1__Norovirus__AJA71423
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaauggcuaugcaggugguuuugaagugcagguaauucucgcggggaacgcguucaccgccgggaaggucauauuugcagcagucccaccaaauuuuccaacugaaggcuugagccccagccagguuacuauguucccccauauaguaguagauguuaggcaauuagaaccuguguugauucccuuacccgauguuaggaauaauuucuaucauuacaaucaaucaaaugaucccaccauuaaguugauagcaauguuguacacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugacggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcaugcucacccaaaccacaaggacagauggcucaacacgcggccacaaagccacaguguauauugggggcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5373 - RNA, 1623 nt, Artificial Sequence
  VP1__Norovirus__AJA71424
augaagauggcgucgagugacgccaacccaucugauggguccgcagccaaccucgucccagaggucagcaaugagguuauggcucuggagcccguuguuggugccgccauugcagcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcaggugauucucgcggggaaugcguucaccgccgggaagguuauauuugcagcagucccaccaaauuuuccaacugaaggcuugagccccagccagguuacuauguucccccauauaguaguagauguuaggcaguuggaaccuguguugauucccuuacccgauguuaggaauaauuuuuaucauuacaaucaaucaaaugaucccaccauuaaguugauagcaauguuguauacaccacuuagggcuaauaaugcuggggaugaugucuucacaguuucuugccgaguucucacgagaccaucccccgauuuugauuuuauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcaugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaacacucccaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugccccuaugggaaauggaacggggcguaaacgugcacuauaa

SEQ ID NO: 5374 - RNA, 1623 nt, Artificial Sequence
  VP1__Norovirus__AJA71425
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauccucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggccaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccguuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucauaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagugccgacuuugcuccaaaacuggguagaguucaauuugaaacugacacagaccgugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggcgagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaacccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcucgcccccaugggaaauggaacggggcguagacgugcacuauaa

SEQ ID NO: 5375 - RNA, 1623 nt, Artificial Sequence
  VP1__Norovirus__AJA71426
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgcugggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaucccaccauuaaguugauagcaauguuguacacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugacggcgugcuccuaggcaccacccaacugucuccugucaacaucugcaccuucagaggagaugucacccauaucacagguagucguaacuacacaaugaauuuggcuucucaaaauuggagcaguuaugacccaacagaagaaaucccagccccucuaggaacuccagauuuuguggggaagauucaaggcaugcucacccaaaccacaaggacagauggcucaacacgcggccacaaagccacaguguacacugggagcgccgacuuugcuccaaaacuggguagaguucaauucgaaacugacacagaccaugauuuugaagcuaaccaaaacacaaaguucaccccaguuggugucauccaagaugguagcaccacccaccgaaaugaaccucaacagugggugcucccaaguuacucaggcagaaauacuccuaaugugcaucuggcccccgcuguagcucccacuuuuccgggugagcaacuucucuucuucagauccaccaugcccggaugcagcggguaccccaauauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5376 - RNA, 1623 nt, Artificial Sequence
  VP1__Norovirus__AJA71427
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugaucuaaaucccuaucuaucccauuuggccagaauguacaaugguuaugcaggugguuuugaagugcagguaauucucgcggggaacgcguucaccgccgggaaggucauauuugcagcagucccaccaaauuuuccaacugaaggccugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggggcaauuaugacccaacagaagagaucccagccccucuaggaacuccagauuuuguggggaagauucaaggcgugcucacccaaacuacaaggacagauggcucaacacguggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5377 - RNA, 1623 nt, Artificial Sequence
  VP1__Norovirus__AJA71428
augaagauggcgucgagugacgccaacccaucugauggguccgcagccaaccucgucccagaggucaacaaugagguuauggcucuggagcccguuguuggugccgccauugcggcaccuguagcgggccaacaaaaugugauugaccccuggauuagaaauaauuuuguacaggccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauccucgcggggaacgcguucaccgccgggaaggucauauuugcagcagucccaccaaauuuuccaacugaaggcuugagccccagccaggucacuauguucccccauauaguaguagauguuaggcaacuagaaccuguguuaauucccuuacccgauguuaggaauaauuucuaucacuacaaucaaucaaaugaccccaccauuaaguugauagcaauguuguauacaccacuuagggccaauaaugcuggggaugauguuuucacaguuucuugccgaguucucacgagaccaucccccgauuuugauuucauauuucuagugccacccacaguugagucaagaacuaaaccauucucugucccagucuuaacuguugaagagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucauaauuacacaaugaaucuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagauggcggcaccacccaccgaaaugaaccccaacagugggugcucccaaguuacucaggcagaaauacuccuaaugugcaucuggcccccgcuguagcccccacuuuuccgggcgagcaacuucucuucuucagauccaccaugcccggaugcagcggguaccccaacauggauuuggacugucugcucccccaggaaugggugcaguacuucuaccaagaggcagccccagcacaaucugauguggcucugcugagauuugugaacccagacacagguaggguuuuguuugaguguaagcuucauaaaucaggcuauguuacaguggcucacacuggccaacaugauuugguuaucccccccaaugguuauuuuagguuugauuccugggucaaccaguuuuauacgcuugcccccaugggaaauggaacggggcguagacgugcacuauaa

SEQ ID NO: 5378 - RNA, 1623 nt, Artificial Sequence
  VP1__Norovirus__AJA71429
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaacgguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucagucaaaugaccccaccaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccagucuuaacuguugaggagaugaccaauucaagguuccccauuccuuuggaaaaguuguucacgggccccaguagugccuuuauuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgauccaacagaagaaaccccagccccccuaggaacuccagauuucguggggaagauucaaggugugcucacccaaaccacaaggacagauggcucgacccgcggccacaaagcuacaguguacacugggagcgccgacuuuucuccaaaacuggguaggguucaauuugccacugacacagacaaugauuuuguaacuaaccaaaacacaaaguucaccccagucgguguuauccaggaugguaguacuaccccccgaaaugaaccccaacaaugggugcucccaaguuacucaggcagaaacacucauaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaacagguuauguuacaguggcucacacuggccaacaugauuuaguuaucccccccaaugguuauuuuagauuugauuccugggucaaccaguucuacacacuugcccccaugggaaaugggacggggcguagacguguauuauaa

SEQ ID NO: 5379 - RNA, 1623 nt, Artificial Sequence
  VP1__Norovirus__AJA71430
augaagauggcgucgagugacgccaacccaucugauggguccgcagccaaccucgucccagaggucaacaaugagguuauggcucuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaaccgaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugacuucauauuucuagugccacccacagucgagucaagaacuaaaccauucucugucccaguuuuaacuguugaggagaugaccaacucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucauaacuacacaaugaauuuggcuucucaaaauuggagcaauuacgacccaacagaagaaaucccagccccucuaggaacuccagacuuuguggggaagauucaaggcgugcuuacccaaaccacaaggacagauggcucaacacgcggccacaaagccacaguguacacugggagcgccgacuuugcuccaaagcuggguagaguucaauuugaaacugacacaaaccaugauuuugaugcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaauguaagcuucauaaaucaggcuaugucacaguggcucacacuggccaacaugauuugguuaucccccccaaugguuauuuuagguuugauuccugggucaaccaauuuuacacgcuugcccccaugggaaauggaacggggcgcagacgugcauuauaa

SEQ ID NO: 5380 - RNA, 1623 nt, Artificial Sequence
  VP1__Norovirus__AJA71456
augaagauggcgucgagugacgccaacccaucugauggguccgcagccaaccucgucccagaggucaacaaugagguuauggcucuggagcccguuguuggugccaccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggcuagaauguacaaugguuaugcgggugguuuugaagugcaggugauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaucccaccauuaaguugauagcaauguuguacacaccacuuagggcuaauaaugcuggggaugaugucuucacaguuucuugccgaguucucacgagaccaucccccgauuuugauuucauauuucuagugccacccacaguugagucaagaacuaaaccauucucugucccaauuuuaacuguugaggagaugaccaauucaagauuccccauuccuuuggaaaaguuguucacgggucccagcagugccuuuguuguccaaccacaaaacgguaggugcacgacugacggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaauuccagauuuuguggggaagauucaaggcaugcucacccaaaccacaaggacagauggcucaacacgcggccacaaagcuacaguauacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggucaacaugauuugguuaucccccccaaugguuauuuuagguuugauuccugggucaaccaguuuuacacgcuugcccccaugggaaauggaacggggcguaggcgugcacuauaa

SEQ ID NO: 5381 - RNA, 1623 nt, Artificial Sequence
  VP1__Norovirus__AJA71457
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuucccaacugaaggcuugagccccagccaggucacuauguucccccauauaguaguagauguuaggcaacuagaaccuguguugauucccuuacccgauguuaggaauaauuucuaucauuacaaucaaucaaaugaccccacuauuaaguugauagcaauguuguauacaccacuuagggcuaauaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaauuggguagaguucaauuugaaacugacacagaccaugauuuugaagcuaaccaaaacacaaaguucaccccaguuggcgucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccagcauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5382 - RNA, 1623 nt, Artificial Sequence
  VP1__Norovirus__AJA71458
augaagauggcgucgagugacgccaacccaucugauggguccgcagccaaccucgucccagaggucaacaaugagguuauggcucuggagcccguuguuggugccgccauugcggcaccuguagcgggccagcaaaaugugauugaccccuggauuagaaauaauuuuguacaggccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauccucgcggggaacgcguucaccgccgggaaggucauauuugcagcagucccaccaaauuuuccaacugaaggcuugagccccagccaggucacuauguucccccauauaguaguagauguuaggcaacuagaaccuguguuaauucccuuacccgauguuaggaauaauuucuaucacuacaaucaaucaaaugaccccaccauuaaguugauagcaauguuguauacaccacuuagggccaauaaugcuggggaugauguuuucacaguuucuugccgaguucucacgagaccaucccccgauuuugauuucauauuucuagugccacccacaguugagucaagaacuaaaccauucucugucccagucuuaacuguugaagagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucauaauuacacaaugaauuuggcuucucaaaauuggagcaauuaugacccagcagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagauggcggcaccacccaccgaaaugaaccccaacagugggugcucccaaguuacucaggcagaaauacuccuaaugugcaucuggcccccgcuguagcccccacuuuuccgggcgagcaacuucucuucuucagauccaccaugcccggaugcagcggguaccccaacauggauuuggacugucugcucccccaggaaugggugcaguacuucuaccaagaggcagccccagcacaaucugauguggcucugcugagauuugugaacccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5383 - RNA, 1623 nt, Artificial Sequence
  VP1__Norovirus__AJA71459
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuucccaacugaaggcuugagccccagccaggucacuauguucccccauauaguaguagauguuaggcaacuagaaccuguguugauucccuuacccgauguuaggaauaacuucuaucauuacaaucaaucaaaugaccccaccauuaaguugauagcaauguuguacacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuugucguccaaccacaaaacgguaggugcacgacugauggcgugcuccuaggcaccacccaacugucuccagucaacaucugcaccuucagaggagaugucacccacaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccauaaagccacaguguacacugggagcgucgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5384 - RNA, 1623 nt, Artificial Sequence
  VP1__Norovirus__AJA71460
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuuggguccugaucuaaaucccuaccuaucccaucuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguccucacgagaccaucccccgauuuugauuucauauuucuagugccacccacaauugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccacaucacaggcagucgaaacuacacaaugaauuuggcuucucaaaauuggaacaauuaugacccaacagaagaaaucccagccccucuagggacuccagauuuuguggggaagauucaaggcgugcucacccaaaccacaaggacagauggcucaacacgcggccacaaagcuacaguguacacugggagcgccgauuucucuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugccugcucccccaggaaugggugcaguacuucuaccaagaggcagccccagcacaaucugauguggcucugcuaagauuugugaauccagacacagguaggguuuuguuugaguguaagcuccauaaaucaggcuauguuacaguggcucacacuggccaacaugauuugguuaucccccccaaugguuauuuuagguuugauuccugggucaaccaguuuuacacgcuugcccccaugggaaauggaacggggcguaggcgugcacuauaa

SEQ ID NO: 5385 - RNA, 1623 nt, Artificial Sequence
  VP1__Norovirus__AJA71461
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacugaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguuuaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuuuagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5386 - RNA, 1623 nt, Artificial Sequence; identical to SEQ ID NO: 5357
  VP1__Norovirus__AJA71462

SEQ ID NO: 5387 - RNA, 1623 nt, Artificial Sequence; identical to SEQ ID NO: 5367
  VP1__Norovirus__AJA71463

SEQ ID NO: 5388 - RNA, 1623 nt, Artificial Sequence
  VP1__Norovirus__AJA71464
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcacauucagaggagaugucacccauaucacagguagucauaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguccaauuugaaacugacacagaccgugauuuugaagcuaaccaaaacacaaaguucaccccaguuggugucauccaagaugguggcaccacccaccgaaacgaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuuaguuaucccccccaaugguuauuuuagguuugauuccugggucaaccaguuuuacacgcuugcccccaugggaaauggaacggggcguagacgugcacuauaa

SEQ ID NO: 5389 - RNA, 1623 nt, Artificial Sequence
  VP1__Norovirus__AJA71465
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccagguuacuauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcacauucagaggagaugucacccauaucacagguagucauaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguccaauuugaaacugacacagaccgugauuuugaagcuaaccaaaacacaaaguucaccccaguuggugucauccaagaugguggcaccacccaccgaaacgaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuuaguuaucccccccaaugguuauuuuagguuugauuccugggucaaccaguuuuacacgcuugcccccaugggaaauggaacggggcguagacgugcacuauaa

SEQ ID NO: 5390 - RNA, 1623 nt, Artificial Sequence
  VP1__Norovirus__AJA71466
augaagauggcgucgagugacgccaacccaucugauggguccgcagccaaccucgucccagaggucaacaaugagguuauggcuuuggagcccguuguuggugccgccauugcggcaccuguagcgggccaacaaaauguaauugaccccuggauuagaaauaauuugguacaagccccugguggagaguuuacaguauccccuagaaacgcuccaggugaaauacuauggagcgcgcccuugggcccugagcuaaaucccuaccuaucccauuuggccagaauguacaaugguuaugcagguggcuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagauguuacccauaucacagguagucguaacuacacaaugaacuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccgguugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5391 - RNA, 1623 nt, Artificial Sequence
  VP1__Norovirus__AJA71467
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugacuaauucaagauuccccauuccuuuagaaaaguuguucacgggucccagcagugccuuuguuguccaaccacaaaacggcaggugcacgacugauggcgugcuccuaggcaccacccaauugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuugugggaaagauucaaggcgugcucacccaaaccacaaggacagauggcucaacacguggccacaaagcuacaguauacacugggagcgcugauuuugcuccaaaacuggguagaguucaauuugaaacugacacagaccaugauuuugaagcuaaccaaaacacaagguucaccccaguuggugucauccaagaugguggcaccacccaccgaaaugaaccccaacagugggugcucccaaguuacucaggcaggaacacuccuaaugugcaucuggccccugcuguagcccccacuuuuccgggugagcaacuucucuucuucagauccaccaugcccggaugcagcggguaccccaacauggauuuggacugucugcucccccaggaaugggugcagcacuucuaccaagaggcagccccagcacaaucugauguggcucugcuaagguuugugaauccagacacagguaggguuuuguuugaauguaagcuucauaaaucaggcuauguuacaguggcucacacuggccagcaugauuugguuaucccccccaaugguuauuuuagguuugauuccugggucaaccaguuuuacacgcuugcccccaugggaaauggaacggggcguagacgugcacuauaa

SEQ ID NO: 5392 - RNA, 1623 nt, Artificial Sequence
  VP1__Norovirus__AJA71470
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggcuagaauguacaaugguuaugcgggugguuuugaagugcaggugauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaucccaccauuaaguugauagcaauguuguacacaccacuuagggcuaauaaugcuggggaugaugucuucacaguuucuugccgaguucucacgagaccaucccccgauuuugauuucauauuucuagugccacccacaguugagucaagaacuaaaccauucucugucccaauuuuaacuguugaggagaugaccaauucaagauuccccauuccuuuggaaaaguuguucacgggucccagcagugccuuuguuguccaaccacaaaacgguaggugcacgacugacggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaauuccagauuuuguggggaagauucaaggcaugcucacccaaaccacaaggacagauggcucaacacgcggccacaaagcuacaguauacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaacgugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggucaacaugauuugguuaucccccccaaugguuauuuuagguuugauuccugggucaaccaguuuuacacgcuugcccccaugggaaauggaacggggcguaggcgugcacuauaa

SEQ ID NO: 5393 - RNA, 1623 nt, Artificial Sequence
  VP1__Norovirus__AJA71471
augaagauggcgucgagugacgccaacccaucugauggguccgcagccaaccucgucccagaggucaacaaugagguuauggcuuuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugagcuaaaucccuaccuaucccauuuggccagaauguacaaugguuaugcagguggcuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuccuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagauguuacccauaucacagguagucguaacuacacaaugaacuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccgguugcagcggguaccccaacagggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5394 - RNA, 1623 nt, Artificial Sequence
  VP1__Norovirus__AJA71472
augaagauggcgucgagugacgccaacccaucugauggguccgcagccaaccucgucccagaggucaacaaugagguuauggcuuuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugagcuaaaucccuaccuaucccauuuggccagaauguacaaugguuaugcagguggcuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagauguuacccauaucacagguagucguaacuacacaaugaacuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccgguugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5395 - RNA, 1623 nt, Artificial Sequence
  VP1__Norovirus__AJA71473
augaagauggcgucgagugacgccagcccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaccccuaccuaucccauuuggccagaauguacaaugguuaugcagguggcuuugaagugcagguaauucucgcggggaacgcguucaccgccgggaaagucauauuugcagcagucccaccaaauuuuccaacugaaggcuugagccccagccaggucacuauguucccccauauaguaguagauguuaggcaauuagaaccuguguugauucccuuacccgacguuaggaauaauuucuaucacuacaaucaaucaaaugaucccaccauuaaguugauagcaauguuguauacaccacuuagggcuaacaaugcuggggaugaugucuucacaguuucuugccgaguucucacgaggccaucccccgauuuugauuucauauuucuagugccacccacaguugagucaagaacuaaaccauucucugucccaguuuuaacuguugaggagaugaccaauucaagauuccccaucccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagacuuuguggggaagauucaaggcgugcucacccaaaccacaaggacagauggcucaacacgcggccacaaagccacaguguauacugggagcgcugacuuugcuccaaaacuggguagaguucaauuugaaacugacacagaccgugauuuugaagcuaaccaaaacacaaaguucaccccaguuggugucauccaagaugguggcaccacccaccgaaaugaaccccaacagugggugcuuccaaguuacucaggcagaaauacuccuaaugugcaucuggcccccgcuguagcccccacuuuuccgggugagcaacuucucuucuucagauccaccaugcccggaugcagcggguaccccaacauggacuuggacugccugcucccccaggaaugggugcaguacuucuaccaagaggcagccccagcacaaucugauguggcucugcuaagauuugugaacccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5396 - RNA, 1623 nt, Artificial Sequence
  VP1__Norovirus__AJA71474
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaauuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaacuacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccuggugagcaacuucucuucuucagauccaccaugcccggaugcagcggguaccccaacacggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccauggggaauggaacggggcguagacgugcacuauaa

SEQ ID NO: 5397 - RNA, 1623 nt, Artificial Sequence
  VP1__Norovirus__AJA71475
augaagauggcgucgagugacgccaacccaucugauggguccgcagccaaccucgucccagaggucaauaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaccccuaccuaucccauuuggccagaauguacaaugguuaugcagguggcuuugaagugcagguaauucucgcggggaacgcguucaccgccgggaaagucauauuugcagcagucccaccaaauuuuccaacugaaggcuugagccccagccaggucacuauguucccccauauaguaguagauguuaggcaauuagaaccuguguugauucccuuacccgacguuaggaauaauuucuaucauuacaaucaaucaaaugaccccaccauuaaguugauagcaauguuguauacaccacuuagggcuaauaaugcuggggaugaugucuucacaguuucuugccgaguucucacgaggccaucccccgauuuugauuucauauuucuagugccacccacaguugagucaagaacuaaaccauucucugucccaguuuuaacuguugaggagaugacuaauucaagauuccccaucccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagacuuuguggggaagauucaaggcgugcucacccaaaccacaaggacagaugguucaacacgcggccacaaagccacaguguacacugggagcgcugacuuugcuccgaaacuggguagaguucaauuugaaacugacacagaccaugauuuugaagcuaaccaaaacacaaaguucaccccaguuggugucauccaagaugguggcaccacccaccgaaaugaaccccaacaaugggugcuuccaaguuacucaggcagaaauacuccuaaugugcaucuggcccccgcuguagcccccacuuuuccgggugagcaacuucucuucuucagauccaccaugcccggaugcagcggguaccccaacauggacuuggacugccugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5398 - RNA, 1623 nt, Artificial Sequence
  VP1__Norovirus__AJA71476
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguguccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguuguagauguuaggcaauuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuuuuaguaccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaauucaccccaguuggugucauucaagaugguagcaccacccaccgaaaugaaccccaacagugggugcucccaaguuacucaggcagaaacacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucauacuggccaacaugauuugguuaucccccccaaugguuauuuuagguuugauuccugggucaaccaguuuuacacgcuugcccccaugggaaauggaacggggcguagacgugcacuauaa

SEQ ID NO: 5399 - RNA, 1623 nt, Artificial Sequence
  VP1__Norovirus__AJF21974
augaagauggcgucgagugacgccaacccaucugauggguccgcagccaaccucgucccagaggucaacaaugagguuauggcucuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggcuagaauguacaaugguuaugcgggugguuuugaagugcgggugauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaucccaccauuaaguugauagcaauguuguacacaccacuuagggcuaauaaugcuggggaugaugucuucacaguuucuugccgaguucucacgagaccaucccccgauuuugauuucauauuucuagugccacccacaguugagucaagaacuaaaccauucucugucccaauuuuaacuguugaggagaugaccaauucaagauuccccauuccuuuggaaaaguuguucacgggccccagcagugccuuuguuguccaaccacaaaacgguaggugcacgacugacggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaauuccagauuuuguggggaagauucaaggcaugcucacccaaaccacaaggacagauggcucaacacgcggccacaaagcuacaguauacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggucaacaugauuugguuaucccccccaaugguuauuuuagguuugauuccugggucaaccaguuuuacacgcuugcccccaugggaaauggaacggggcguaggcgugcacuauaa

SEQ ID NO: 5400 - RNA, 1623 nt, Artificial Sequence
  VP1__Norovirus__AJF21975
augaagauggcgucgagugacgccaacccaucugauggguccgcagccaaccucgucccagaggucaacaaugagguuauggcucuggagcccguuguaggugccgccauugcggcaccuguagcgggccaacaaaauguaauugaccccuggauuagaaauaauuuuguacaagccccugguggagaguucacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaagguuugagccccagccaggucacuauguuuccccauauaguaguagauguuaggcaacuagaaccuguguugauucccuuacccgauguuaggaauaauuucuaucauuacaaccaaucaaaugaccccaccauuaaauugauagcaauguuguacacaccacuuagggcuaauaaugcuggggaugaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuuuagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccauaaagccacaguguacacugggagcgccaauuuugcuccaaaacuggguagaguccaauuugaaacugacacagaccaugauuuugaagccaaccaaaacacaaaguucaccccaguuggugucauccaagaugguggcaccacccaccgaaaugaaccccaacagugggugcucccaaguuacucaggcagaaauacuccuaaugugcaucuggccccugcuguagcccccacuuuuccgggugagcaacuucucuucuucagauccaccaugcccggaugcagcggguaccccaacauggauuuggacugucuacuuccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaauggcuauuuuagguuugauuccugggucaaccaguuuuacacgcuugcccccaugggaaauggaacggggcgcagacgugcgcuauaa

SEQ ID NO: 5401 - RNA, 1623 nt, Artificial Sequence
  VP1__Norovirus__AJF21976
augaagauggcgucgagugacgccaacccaucugauggguccgcagccaaccucgucccagaggucaacaaugaggucauggcucuggagcccguuguaggugcugccauugcggcaccuguagcgggccaacaaaauguaauugaccccuggauuagaaauaauuuuguacaagccccugguggagaguucacaguauccccuagaaacgcuccaggugaaauacuauggagcgcgcccuugggcccugaucuaaaucccuaccuaucccauuuggccaggauguacaaugguuaugcaggugguuuugaagugcagguaauucucgcggggaacgcguucaccgccgggaaggucauauuugcagcagucccaccaaauuuuccaacugaagguuugagccccagccaggucacuauguucccccauauaguaguagauguuaggcaacuagaaccuguguugauucccuuacccgauguuaggaauaauuuuuaucauuacaaucaaucaaaugaccccaccauuaaguugauagcaauguuguacacaccacuuagggcuaauaaugcuggggaugaugucuucacaguuucuugccgaguucucacgagaccaucccccgauuuugauuucauauuucuagugccacccacaguugagucaaggacuaaaccauucucugucccaguucuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccuguuaacaucugcaccuucagaggagaugucacccauaucacagguagucgcaacuacacaaugaaucuggcuucucaaaauuggagcaauuaugacccaacagaagaaaucccagccccucuaggaacuccagauuuuguggggaagauucaaggcaugcucacccaaaccacaaggacagauggcucaacacgcggccacaaagccacaguguacacugggagcgcugacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggccccugcuguagcccccacuuuuccgggugagcagcuucucuucuucagauccaccaugcccggaugcagcggguaccccaacauggauuuggacugucuacucccccaggaaugggugcaguacuucuaccaagaggcagccccagcacaaucugauguggcucugcuaagauuugugaauccagauacagguaggguuuuguuugaguguaagcuucauaaaucaggcuauguuacaguggcucacacuggccaacaugacuugguuaucccccccaauggcuauuuuagguuugauuccugggucaaccaguuuuacacgcuugcccccaugggaaauggaacggggcguagacgugcacuauaa

SEQ ID NO: 5402 - RNA, 1623 nt, Artificial Sequence
  VP1__Norovirus__AJF21977
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguucacaguauccccuagaaacgcuccaggugaaauacuauggagcgcgccccugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguggauguuaggcaacuagaaccuguguugauucccuuacccgauguuaggaauaauuucuaccauuacaaucaaucaaaugaccccaccauuaaguugauagcaauguuguauacaccacucagggcuaauaaugcuggggaugaugucuucacaguuuccugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucauaacuacacaaugaauuuggcuucucaaaauuggagcaauuaugauccaacagaagaaaucccagccccucuaggaacuccagauuuuguggggaagauucagggcgugcucacccaaaccacaaggacagauggcucaacacgcggccacaaagccacaguguacacugggagcgccgacuuugcuccaaaacuggguagaguucaauuugaaacugacacaaaccaugauuuugaagcuaaccaaaacacaaaguucaccccaguuggugucauccaagaugguagcaccacccaccgaaaugaaccccaacagugggugcucccaaguuacucaggcagaaauacucccaaugugcaucuggcccccgcuguagcccccacuuuuccgggugagcaacuucuuuucuucagauccaccaugcccggaugcagcggguaccccaacauggauuuggacugucugcucccccaggaaugggugcaguacuucuaccaagaggcggccccagcacaaucugauguggcucugcuaagauuugugaauccagacacagguaggguuuuguuugaguguaagcuucauaaaucaggcuauguuacaguggcucacacuggccaacaugauuugguuauuccccccaaugguuauuuuagguuugauuccugggucaaccaguuuuacacgcuugcccccaugggaaauggaacggggcguagacgugcacuauaa

SEQ ID NO: 5403 - RNA, 1623 nt, Artificial Sequence
  VP1__Norovirus__AJF21978
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaauuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuucccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaacuacaaggacagauggcucaacacgcggccacaaagccacaguguacacugggagcgccgacuuugcuccaaaacuggguagaguucaauuugaaacugacacagaccaugauuuugaaacuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccuggugagcaacuucucuucuucagauccaccaugcccggaugcagcggguaccccaacacggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5404 - RNA, 1623 nt, Artificial Sequence
  VP1__Norovirus__AJF21979
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguucacaguauccccuagaaacgcuccaggugaaauacuauggagcgcgccccugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguggauguuaggcaacuagaaccuguguugauucccuuacccgauguuaggaauaauuucuaccauuacaaucaaucaaaugaccccaccauuaaguugauagcaauguuguauacaccacuuagggcuaauaaugcuggggaugaugucuucacaguuuccugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggccccagcagugccuuuguuguccaaccacaaaacggcaggugcacgacugauggcgugcuccuaggcaccacccaacugucuccugucaacaucugcaccuucagaggagaugucacccauaucacagguagucauaacuacacaaugaauuuggcuucucaaaauuggagcaauuaugacccaacagaagaaaucccagccccucuaggaacuccagauuuuguggggaagauucagggcgugcucacccaaaccacaaggacagauggcucaacacgcggccacaaagccacaguguacacugggagcgccgacuuugcuccaaaacuggguagaguucaauuugaaacugacacaaaccaugauuuugaagcuaaccaaaacacaaaguucaccccaguuggugucauccaagaugguggcaccacccaccgaaaugaaccccaacagugggugcucccaaguuacucaggcagaaauacucccaaugugcaucuggcccccgcuguagcucccacuuuuccgggugagcaacuucucuucuucagauccaccaugcccggaugcagcggguaccccaacauggauuuggacugucugcucccccaggaaugggugcaguacuuuuaccaagaggcggccccagcacaaucugauguggcucugcuaagauuugugaauccagacacagguaggguuuuguuugaguguaagcuucauaaaucaggcuauguuacaguggcucacacuggccaacaugauuugguuauuccccccaaugguuauuuuagguuugauuccugggucaaccaguuuuacacgcuugcccccaugggaaauggaacggggcguagacgugcacuauaa

SEQ ID NO: 5405 - RNA, 1623 nt, Artificial Sequence
  VP1__Norovirus__AJF21980
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguguccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuuaagccccagccaggucacuauguucccccauauaguaguagauguuaggcaacuagaaccuguguugauucccuuacccgauguuaggaauaauuucuaccauuauaaccaaucaaaugaccccaccauuaaguugauagcaauguuguauacaccacuuagggcuaauaaugcuggggacgaugucuucacaguuucuugccgaguucucacaagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggucccagcagugccuuuguuguucaaccacaaaacggcaggugcacgacugauggcgugcuccuaggcaccacccaacugucuccugucaacaucugcaccuucagaggggaugucacccauaucacaggcagucgcaacuacacaaugaauuuggcuucucaaaauuggaacaauuaugacccaacggaagaaaucccagccccucuaggaacuccagacuuuguggggaagauucaaggcaugcucacccaaaccacgaggacugauggcucaacacgcggccacaaagccacaguguacacugggagcgccgacuuugcuccaaaacuggguagaguucaauuugaaacugacacagaccaugauuuugaagcuaaccaaaauacaaaguucaccccagucggugucauccaagaugguagcaccacccaccgaaaugaaccccaacagugggugcucccaaguuacucaggcagaaauacucauaaugugcaucuggcccccgccguagcccccacuuuuccgggugagcaacuccucuucuucagauccaccaugcccggaugcagcggguaccccaacauggauuuggacugucugcucccccaggaaugggugcaguacuucuaccaagaggcagccccagcacaaucugauguggcacugcuaagauuugugaauccagacacagguaggguuuuguuugaguguaagcuucauaaaucagguuauguuacaguggcucacacuggccaacaugauuugguuaucccccccaaugguuauuuuagguuugauucuugggucaaccaguucuacacgcuugcccccaugggaaauggaacggggcguagacguguaguauaa

SEQ ID NO: 5406 - RNA, 1623 nt, Artificial Sequence
  VP1__Norovirus__AJF21981
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggcuagaauguacaaugguuaugcgggugguuuugaagugcaggugauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaucccaccauuaaguugauagcaauguuguacacaccacuuagggcuaauaaugcuggggaugaugucuucacaguuucuugccgaguucucacgagaccaucccccgauuuugauuucauauuucuagugccacccacaguugagucaagaacuaaaccauucucugucccaauuuuaacuguugaggagaugaccaauucaagauuccccauuccuuuggaaaaguuguucacgggucccagcagugccuuuguuguccaaccacaaaacgguaggugcacgacugacggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaauuccagauuuuguggggaagauucaaggcaugcucacccaaaccacaaggacagauggcucaacacgcggccacaaagcuacaguauacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggucaacaugauuugguuaucccccccaaugguuauuuuagguuugauuccugggucaaccaguuuuacacgcuugcccccaugggaaauggaacggggcguaggcgugcacuauaa

SEQ ID NO: 5407 - RNA, 1623 nt, Artificial Sequence
  VP1__Norovirus__AJF21982
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccuucccccgauuuugacuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucuguacauucagaggagaugucacccauaucacagguagucauaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguccaauuugaaacugacacagaccgugauuuugaagcuaaccaaaacacaaaguucaccccaguuggugucauccaagaugguggcaccacccaccgaaacgaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuuaguuaucccccccaaugguuauuuuagguuugauuccugggucaaccaguuuuacacgcuugcccccaugggaaauggaacggggcguagacgugcacuauaa

SEQ ID NO: 5408 - RNA, 1623 nt, Artificial Sequence
  VP1__Norovirus__AJF21983
augaagauggcgucgagugacgccaacccaucugauggguccgcagccagccucgucccagaggucaacaaugagguuauggcucuggagcccguuguuggugccgccauugcggcaccuguagcgggccaacaaaauguaauugaccccuggauuagaaauaauuuuguacaagccccugguggagaguucacaguauccccuagaaacgcuccaggugaaauacuauggagcgcgcccuuggguccugaucuaaaucccuaccuaucccaucuggccagaauguacaaugguuaugcaggugguuuugaagugcagguaauccucgcggggaacgcguucaccgccgggaaggucauauuugcagcagucccaccaaauuuuccaacugaaggcuugagccccagccaggucacuauguucccccauauaguaguagacguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguccucacgagaccaucccccgauuuugauuucauauuucuagugccacccacaguugagucaagaacuaaaccauucucugucccaguuuuaacuguugaggagaugaccaauucaagauuccccaucccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacaggcagucgaaacuacacaaugaauuuggcuucucaaaauuggaacaauuaugacccaacagaagaaaucccagccccucuagggacuccagauuuuguggggaagauucaaggcgugcucacccaaaccacaaggacagauggcucaacacgcggccacaaagcuacaguguacacugggagcgcugauuuuucuccaaaacuggguagaguucaauuugaaacugauacagaccgugauuuugaagcuaaccaaaacacaaaguucaccccaguuggugucauccaagaugguggcaccacccaccgaaaugaaccccaacagugggugcucccaaguuacucaggcagaaaugcuccuaaugugcaucuggcccccgcuguagcccccacuuuuccgggugagcaacuucucuucuucagauccaccaugcccggaugcagcggguaccccaacauggauuuggacugccugcucccccaggaaugggugcaguacuucuaccaagaggcagccccagcacaaucugauguggcucugcuaagauuugugaauccagacacagguaggguuuuguuugaguguaagcuccauaaaucaggcuauguuacaguggcucacacuggccaacaugauuugguuauaccccccaaugguuauuuuagguuugauuccugggucaaccaguuuuacacgcuugcccccaugggaaauggaacggggcguaggcgugcacuauaa

SEQ ID NO: 5409 - RNA, 1623 nt, Artificial Sequence
  VP1__Norovirus__AJF21984
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguucacaguauccccuagaaacgcuccaggugaaauacuauggagcgcgccccugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccucauauaguaguggauguuaggcaacuagaaccuguguugauucccuuacccgauguuaggaauaauuucuaccauuacaaucaaucaaaugaccccaccauuaaguugauagcaauguuguauacaccacuuagggcuaauaaugcuggggaugaugucuucacaguuuccugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucauaacuacacaaugaauuuggcuucucaaaauuggagcaauuaugacccaacagaagaaaucccagccccucuaggaacuccagauuuuguggggaagauucagggcgugcucacccaaaccacaagggcagauggcucaacacgcggccacaaagccacaguguacacugggagcgccgacuuugcuccaaaacuggguagaguucaauuugaaacugacacaaaccaugauuuugaagcuaaccaaaacacaaaguucaccccaguuggugucauccaagaugguggcaccacccaccgaaaugaaccccaacagugggugcucccaaguuacucaggcagaaauacucccaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaucaagaggcggccccagcacaaucugauguggcucugcuaagauuugugaauccagacacagguaggguuuuguuugaguguaagcuucauaaaucaggcuauguuacaguggcucacacuggccaacaugauuugguuauuccccccaaugguuauuuuagguuugauuccugggucaaccaguuuuacacgcuugcccccaugggaaauggaacggggcguagacgugcacuauaa

SEQ ID NO: 5410 - RNA, 1623 nt, Artificial Sequence
  VP1__Norovirus__AKE37037
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaauuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuacaccccacucagaucuaauggcucaggugaugaugucuuuacugucucuugcaggguucugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuguucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 5411 - RNA, 1632 nt, Artificial Sequence
  VP1__Norovirus__AKM20815
augaugauggcgucuaaggacgccccaacaaacauggauggcaccaguggugccggucagcugguaccagaggcaaauacggcugaaccuuuaccaauaaaaccaguggccggggcugcgacugcgguugcaaccgccggucagguaaauaugauugaccccuggauaaugaacaauuuuguacaggcuccccaaggggaguuuaccauuuccccaaauaauacaccuggugauauuuuauuugauuugcaauuaggaccacaucuuaauccuuucuuggcucauuugucuagaauguauaaugguuggguugggaauaugcagguccgcauaaugcuugcugguaaugccuuuucagcuggaaagauuauugugugcugcauaccgccggguuuuucuucucaaucuauuucuauugcucaagcuacaauguucccacaugucauagcugaugucagaguguuagaaccuauugauguacccuuagaugauguuagaaauguccuuuuucauaauaaugauaacccccaaacgaugagauugcuuugcauguuguauacaccccuucggucuggugguacaucuucagguacagauccuuuugucauugcuggucgugucuugaccugccccacaccugauuuuaguuucuuguuccuugucccuccugauaucgagcaaagaacuaagcccuucaguguacccaauaucccuaugaaccugauguccaauucccguguuucaauguugauugaugguaugaugguuucaaaugaucagaaucaagucccccaguuucagaauggucgagucacuuuagauggacagcugcaggguaccaccacaguuucagcugcguguguagcaaggaugagggggcgcauuuuuaauaauaauggcaauuauggugugaaucugacugaacuggauggcaaucccuaucaugccuuugauagcccggcuccuuuaggcuuuccugacuuugggaauugugauuugcacaugaccuuuguuaaaauuaaucccaaugaguuguccucuggagacccuucuggcaaaguggucauucguuccuacgaugccacuuuugccccccaucuugguacugucaaacuggagaaugaugaugagcuagcucgguuuguggguaaggagguaguacuggagcugacguggguuuccaacagagagggugccacccuuaaucuaugggcuguuccaaauuaugguuccaguuugacacaggcgucacagcuugccccaccaauuuaccccccuggguuuggugaggcuauuguguauuucaccucuacuuuuccaacagucagcaacccaaaagucccauguacacuuccucaagaauuuguuucacauuuugucaaugaacaggcccccacacgcggcgaugccgcucuucuucauuauguugauccugacacacaccguaaucuuggagaguuuaagauguacccugagggcuacaugacaugugucccuaaugcugguggugggccacaaaccuuaccaaucaaugguguauuugucuucauuucuuggguuucuagauauuaccaguuaaagccugugggaacugccggugcggcuaggaggcuuggucuuaggagaucauaa

SEQ ID NO: 5412 - RNA, 1623 nt, Artificial Sequence
  vp1__Norovirus__AKM20818
augaugauggcgucuaaggacgcuccaacauccccugauggcgcuaguggcgccggccagcugguaccggaggcuaauacagcugagcaaaucucaauggacccuguugcgggugcuucaacagcagucgcaacggcugggcaaguuaacaugauugacccauggaucuucaauaacuuuguccaagcgccccaaggagaauucacuauuuccccuaauaauacccccggugauauuuuguuugaucuacaacuaggaccccaucuuaacccauuucuagcccaucucucacagauguauaaugguugggucggcaauaugcgugugcgcauauuguuggccggcaacgccuucacagcuggaaagauaaucauuugcuguguccccccuggcuuugaugcuagaauacucacaauagcucaagcaacucucuucccacauuugauugcugacguuaggacccuugagccuguggagcuuccuuuggaggacguacgcaacguucucuaccacaacaguagccagccgcagccaacaaugcggcugguugcuauguuguauaccccccuccgcacugguggugguucuggaggcacugaugccuuugugguggcgggcagggugcuuacgugccccgccccugacuuuagcuuuuuguuucuuguucccccuuccguugaacaaaagaccagaguuuuuaguguccccaauauaccucugaaagaucucucaaauucucgugucccugugccuauacagggcauguuuauguccccagauguuaaucagucaguccaguuucaaaacgggcgcugccaaauugauggucaacuccagggcaccaccccagucucgcucagccaacucugcaagauuagggguaaaacuucaagcaaugccagggugcucaacuugagugagguagaugguacacccuucaucccccuugaaucaccagcgccaguagguuuucccgacuuaggaggcugugacuggcacguaaauuucucuuuccagacucaagaucgggacccaucucaaagugugaccuuugcaaccaaugaugccagcuuuguucccuaccuagguagugucuccccucacaauggggaagguuuucaagcaggcgacaucauagguagccuuggguggauuucagccccgucugauaauucacaauuuaauguuugggcaauaccaaaguauggaucuagucucccagaugucacccaucuugcuccugcuguguuccccccaggcuuuggggaggugauccuauauuucuacuccaccuucccagguucuggacaacccagucaacuucaagucccauguuuguuaccucaggaguucaucacccacuucugcaacgaacaggcucccaucgcuggggaggcugcccuccuccacuacguggacccugacacggggcgaaacuugggggaauucaaacuuuauccugauggauuuaugaccugugucccuaauaguguuagcaguggcccucaaacccuucccauuaauggagucuuugucuuuguuucauggguauccagauucuaucaacucaagccugugggaacggccucagcggcuagaaggcuuggauugcggcguauauaa

SEQ ID NO: 5413 - RNA, 1623 nt, Artificial Sequence
  VP1__Norovirus__ALD83748
augaagauggcgucgaaugacgccgcuccaucuaaugauggugccacgggccucgucccagaggucaacaacgagacccuuccucuggaaccgguagcgggugcagcuauugccgcgccuguuacuggccaaaauaauauaauugaucccuggauuagaacaaauuuuguacaagcacccaauggggaguucacagucucacccagaaacucuccuggagaaauucuucuaaauuuggaauuggguccugauuuaaauccauaucuggcacauuuaucuagaauguauaauggguacgcugguggcguagaaguucaaguccuccuugcagggaaugcguucacugcaggaaagauucucuucgcugccguaccaccaaauuucccaguugaauucuugaguccugcacaaaucaccauguugccacauuuaauaguugauguuagaacccuugaacccaucaugauaccacucccugauguuaggaacaccuucuuccauuacaauaaucaaccuaccaaucgcaugcgauugguagccauguuguacaccccccugagaucuaaugguucuggugaugauguuuucacagugucauguagagugcuaacuagacccaccccagauuuugaguucacauauuugguccccccuucgguagagucuaagacuaaacccuuuucucugcccauacuaaccaucucugaauugaccaauucaagauuuccuguaccgguggauucauuguucacagcccaaaacaauaaucuuaauguucaaugucaaaauggucgcugcacauuagauggugaguugcagggaaccacucaguugcaaccaucaggcaucugcgccuuuagaggcaaaauaacggcagauguacguccaaaccacgaugacagauggcauaugcaauugacaaaccucaauggaacccccuucgacccaacagaggaugugccagcuccacugggcaccccagauuucacaggccuucucuucggaguggcaagccaaagaaauguucaaccuaacccaaacaccaccagggcacaugaagccgugauauccacaaccaguucacaguuugugccaaaauuaggaucaaucaacuuugguagcacaagugaagauuucauugugggccagcccacaaaauuuacaccaguuggcaucaagauugaggauggacaugcauuugaucaauggacccuacccagguauucaggccauuuaacucucaauaugaaucuugccccaccuguugcuccaaauuucccuggugaacaauuacucuucuuuaggucaaauguccccugugccggcggcauuagcgauggugucaucgauugcuuguugccucaggaguggauacagcacuucuaccaggagucugcucccucccaguccgauguggcccugaucagauacgucaaccccgacacgggccgcacacuuuucgaggcgaaacuccauagaacaggcuacaucacuguugcucauucaggugauuauccccuuguuguccccuccaauggauacuuuagauuugauucuugggugaaccaauuuuacucacuugcccccaugggaaccgggaaugggcgcagacgggugcaguaa

SEQ ID NO: 5414 - RNA, 1623 nt, Artificial Sequence
  VP1__Norovirus__ALF12528
augaagauggcgucgagugacgccaacccaucugauggguccacagccaaccucgucccagaggucaacaaugagguuauggcuuuggagcccguuguuggugccgccauugcggcaccuguagcgggccaacaaaacguaauugaccccuggauuagaaacaauuuuguacaagccccugguggagaguuuacaguauccccuagaaacgcuccaggugaaauacuguggagcgcgcccuuaggcccugauuugaaucccuaccuuucccauuuggccagaauguacaaugguuaugcaggugguuuugaagugcaggugauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaucauuauaaucaaucaaaugaccccaccaucaaauugauagcaauguuguauacaccacuuagggcuaauaaugcuggggacgaugucuucacaguuucuugucgaguucucacgagaccaucccccgauuuugauuucauauuuuuagugccacccacaguugaaucaagaacuaaaccauucucugucccaauuuuaacuguugaggagaugaccaauucaagguuccccauuccuuuggaaaaguuguucacgggccccaguaguaccuuuguuguucaaccacaaaacggcaggugcacgacugauggugugcuccuagguacuacccaacugucucccgucaacaucugcaccuucagaggggaugucacccauauugcaggcagccauaacuacacaaugaaucuggcuucccaaaauuggaacaguuaugacccaacagaagaaaucccagccccucuaggaacuccagauuucguggggaagauucaaggugugcucacccaaaccacaaggacggauggcucgacccgcggccacaaagcuacaguguacacugggagcgccgacucuucuccaaaacuggguagaguucaauuugccacugacacagacaaugauuuuguugcuaaccaaaacacaaaguucaccccagucgguguuauccaggauggugguacugcccaccgaaaugaaccccaacaaugggugcucccaagcuacucgggcagaaauacucauaaugugcaccuggcccccgcuguagcccccacuuuuccgggugagcagcuccucuuuuucaggucuaccaugcccggaugcagcggguaccccaacauggauuuggacugucugcucccccaggaaugggugcaguauuucuaccaggaggcagccccagcacaaucugauguggcucugcuaagauuugugaauccagacacagguaggguuuuguuugaguguaagcuccauaaaucaggcuauguuacacaggcucacacuggccaacaugauuuggucaucccccccaaugguuauuuuagauuugauuccugggucaaccaguucuacacacuugcccccaugggaaaugggacggggcgcaggcgagcuuuauaa

SEQ ID NO: 5415 - RNA, 1623 nt, Artificial Sequence
  VP1__Norovirus__ALF12529
augaagauggcguccagugacgccaacccaucugauggguccgcagccaaccucgucccagaggucaacaaugagguuauggcuuuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucguauuuucagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguauacaccacuuagggcuaauaaugcuggggacgaugucuucacaguuucuugucgaguucucacgagaccaucccccgauuuugauuucauauuuuuagugccacccacaguugaaucaagaacuaaaccauucucugucccaauuuuaacuguugaggagaugaccaauucaagguuccccauuccuuuggaaaaguuguucacgggccccaguaguaccuuuguuguucaaccacaaaacggcaggugcacgacugauggcgugcuccuagguacuacccaacugucuccugucaacaucugcaccuucagaggggaugucacccauauugcaggcagucguaacuacacaaugaaucuggcuucccaaaauuggaacaguuaugacccaacagaagaaaucccagccccucuaggaacuccagauuucguggggaagauucaaggugugcucacccaaaccacaaggacggauggcucgacccgcggccacaaagcuacaguguacacugggagcgccgacuuuucuccaaaacuggguagaguucaauuugccacugacacagacaaugauuuugaugcuaaccaaaacacaaaguucaccccagucgguguuauccaggaugguaauacugcccaccgaaaugaaccccaacaaugggugcucccaaguuacucaggcagaaauacucauaaugugcaccuggcccccgcuguagcccccacuuuuccgggugagcagcuccucuucuucagaucuaccaugcccggaugcagcggguaccccaacauggauuuggacugucugcucccccaggaaugggugcaguacuucuaccaggaggcagccccagcacaaucugauguggcucugcuaagauuugugaauccagauacagguaggguuuuguuugaguguaagcuucauaaaucaggcuauguuacaguggcucacacuggccaacaugauuugguuaucccccccaaugguuacuuuagauuugauuccugggucaaccauuucuauacacuugcccccgugggaaaugggacggggcguagacgugcauuauaa

SEQ ID NO: 5416 - RNA, 1623 nt, Artificial Sequence
  VP1__Norovirus__ALF12530
augaagauggcguccagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaacgguuaugcaggugguuuugaagugcagguaauccucgcggggaacgcguucaccgccgggaagaucauauuugcagcagucccaccaaauuucccaacugaagguuugagccccagccaggucacuauguucccccacauaauaguagauguuaggcaauuagaaccuguguugauccccuuacccgauguuaggaauaauuucuaccauuauaaucaaucaaaugaccccaccaucaaauugauagcaauguuguauacaccacuuagggcuaauaaugcuggggacgaugucuucacaguuucuugucgaguucucacgagaccaucccccgauuuugauuucauauuuuuagugccacccacaguugagucaagaacuaaaccauucucugucccaauuuuaacuguugaggagaugaccaauucaagguuccccauuccuuuggaaaaguuguucacgggucccaguagugccuuuguuguucaaccacaaaacggcaggugcacgacugacggcgugcuccuagguacuacccaacugucuccugucaacaucugcaccuucagaggggaugucacccauauugcaggcagucauaacuacacaaugaaucuggcuucccaaaauuggaacaguuaugacccaacagaagaaauuccagccccucuaggaacuccagauuucguggggaagauucaaggugugcucacccaaaccacaagggcggauggcucgacccgcggccacaaagcuacaguguacacugggagcgccgacuuuucuccaaaacuggguagaguucaauuugccacugacacaaacaaugauuuugaugcuaaccaaaacacaaaguucaccccagucgguguuauccaggauggugaaacugcccaccgaaaugaaccccaacaaugggugcucccaaguuacucaggcagaaauauucauaaugugcaccuggcccccgcuguagcccccacuuuuccaggugagcagcuccucuucuucagaucuaccaugcccggaugcagcggguaccccaacauggaguuggacugucugaucccccaggaaugggugcaguauuucuaccaggaggcagccccagcacaaucugauguggcucugcuaagauuugugaauccagacacagguaggguuuuguuugaguguaagcuucauaaaucaggcuauguuacaguggcucacacuggccaacaugaucuggucaucccccccaacgguuauuuuagauuugauuccugggucaaccaguucuacacacuugcccccaugggaaacgggacggggcguagacgugcuuuauaa

SEQ ID NO: 5417 - RNA, 1623 nt, Artificial Sequence
  VP1__Norovirus__ALF12531
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugacuccaccaucaaauugauagcaauguuguauacaccacuuagggcuaauaaugcuggggacgaugucuucacaguuucuugucgaguucucacgagaccaucccccgauuuugauuucauauuuuuagugccacccacaguugaaucaagaaccaaaccauucucugucccaauuuuaacuguugaggagaugaccaauucaagguuccccauucccuuggaaaaguuguucacgggccccaguagugccuuuguuguccaaccacaaaacggcaggugcacgacugauggcgugcuccuagguacuacccaacugucuccugucaauaucugcaccuucagaggggaugucacccauauugcaggcagucguaacuacacaaugaaucuggcuucccaaaauuggaacaguuaugacccaacagaagaaaucccagccccucuagaaaccccagauuucguggggaagauucaaggugugcucacccaaaccacaaggacagauggcucgacccgcggccacaaagcuacaguguacacugggagcgccgacuuuucuccaaaacuggguagaguucaauuugccacugacacagacaaugauuucgauucuaaccaaaacacaaaguucaccccagucgguguuauccaggauggugguacuacccaccgaaacgaaccccaacaaugggugcucccaaguuacucaggcagagauauucauaaugugcaccuggcccccgcuguagcucccacuuuuccgggugagcaacuccucuuuuucagaucuaccaugcccggaugcagcggguaccccaacauggauuuggacugucugcucccccaggaaugggugcaguauuucuaccaggaagcagccccagcacaaucugauguggcucuguuaagauuugugaauccagacacagguaggguuuuguuugaguguaagcuucauaaaucaggcuauguuacaguggcccacacuggccaacaugauuugguuaucccccccaaugguuauuuuagauuugauuccugggucaaccaguucuacacacuugcccccaugggaaaugggacggggcgcagacguguuuuauaa

SEQ ID NO: 5418 - RNA, 1623 nt, Artificial Sequence
  VP1__Norovirus__ALF12532
augaagauggcgucgagugacgccaacccaucugauggguccacagccaaccucgucccagaggucaacaaugagguuauggcuuuggagcccguuguuggugccgccauugcggcaccuguagcgggccaacaaaaugcaauugaccccuggauuagaaacaauuuuguacaagccccugguggagaguuuacaguauccccuagaaacgcuccaggugaaauacuauggagcgcgcccuuaggcccugauuugaaucccuaccuuucucauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugacuccaccaucaaauugauagcaauguuguauacaccacuuagggcuaauaaugcuggggacgaugucuucacaguuucuugucgaguucucacgagaccaucccccgauuuugauuucauauuuuuagugccacccacaguugaaucaagaaccaaaccauucucugucccaauuuuaacuguugaggagaugaccaauucaagguuccccauuccuuuggaaaaguuguucacgggccccaguagugccuuuguuguccaaccacaaaacggcaggugcacgacugauggcgugcuccuagguacuacccaacugucuccugucaacaucugcaccuucagaggggaugucacccauauugcaggcagucguaacuacacaaugaaucuggcuucccaaaauuggaacaguuaugacccaacagaagaaaucccagccccucuaggaacuccagauuucguggggaagauucaaggugugcucacccaaaccacaaggacagauggcucgacccgcggccacaaagccacaguguacacugggagcgccgacuuuucuccaaaacuggguagaguucaauuugccacugacacagacaaugauuucgaugcuaaccaaaacacaaaguucaccccagucgguguuauccaggauggugguacuacccaccgaaaugaaccccaacaaugggugcucccaaguuacucaggcagaaauauucauaaugugcaccuggcccccgcuguagcucccacuuuuccgggugagcaacuccuuuuuuucagaucuaccaugcccggaugcagcggguaccccaacauggauuuggacugucugcucccccaagaaugggugcaguauuucuaccaggaagcagccccagcacaaucugacguggcucugcuaagauuugugaauccagacacagguaggguuuuguuugaguguaagcuucauaaaucaggcuaugucacaguggcccacacuggccaacaugauuugguuaucccccccaaugguuauuuuagauuugauuccugggucaaccaguucuacacacuugcccccaugggaaaugggacggggcguagacgugcuuuauaa

SEQ ID NO: 5419 - RNA, 1623 nt, Artificial Sequence
  VP1__Norovirus__ALF12533
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccacuuggccagaauguacaaugguuaugcaggugguuuugaagugcagguaauccucgcggggaacgcguucaccgccgggaaaaucacauuugcagcagucccaccaaauuucccaacugaagguuugagccccagccaggucacuauguucccccacauaauaguagauguuaggcaauuagaaccuguguugauccccuuacccgauguuaggaauaauuucuaucacuauaaucaaucaaaugaccccaccaucaaauugauagcaauguuguauacaccacuuagggcuaauaaugcuggggacgaugucuucacaguuucuugucgaguucucacgaggccaucccccgauuuugauuucauauuuuuagugccacccacaguugaaucaagaacuaaaccauucucugucccaauuuuaacuguugaggagaugaccaauucaagguuccccauuccuuuggaaaaguuguucacgggccccaguaguaccuuuguuguucaaccacaaaacggcaggugcacgacugauggcgugcuccuggguacuacccaacugucuccugucaacaucugcaccuucagaggggaugucacccauauuacaggcagucauaacuacacaaugaaccuggcuucccaaaauuggagcaguuaugacccaacagaagaaaucccagccccucuaggaaccccagauuucguggggaagauccaaggugugcucacccaaaccacaaggacagauggcucgacccgcggccacaaagcuacaguguucacugggagcgcugacuuuucuccaaaacuggguagaguucaauuugccacugacacagacaaugauuuuguugcuaaccaaaacacaaaguucaccccagucgguguuauccaggauggugguacugcccaccgaaaugaaccccaacaaugggugcucccaaguuacucaggcagaaauauucacaauguacaccuggcccccgcuguagcccccacuuuuccgggugagcaacuccucuucuucagauccaccaugcccggaugcagcggguaccccaacauggauuuggacugucugcucccccaggaaugggugcaguauuucuaccaggaagcagccccagcacaaucugauguggcucugcuaagauuugugaauccagacacagguaggguuuuguuugaguguaagcuucauaaaucaggcuauguuacaguggcucacacuggccaacaugauuugguuaucccccccaacgguuauuuuagguuugacuccugggucaaccaguucuacacacuugcccccaugggaaaugggacggggcgcagacgagcauuauaa

SEQ ID NO: 5420 - RNA, 1623 nt, Artificial Sequence
  VP1__Norovirus__ALF12534
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggucugagccccagccaggucacuauguucccccacauaauaguagauguuaggcaauuggaaccuguguugauccccuuacccgauguuaggaauaauuucuaucauuauaaucaaucaaaugacuccaccaucaaauugauagcaauguuguacacaccacuuagggcuaauaaugccggggacgaugucuucacaguuucuugucgaguucucacgagaccaucccccgauuuugauuuuauauuuuuggugccacccacaguugaaucaagaacuaaaccauucucuguuccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagccacaguguacacugggagcgccgacuuuucuccaaaacuggguagaguucaauuugccacugacacagacaaugauuuugaaacuaaccaaaacacaaaguucaccccagucggcguuauccaggaugguaguacuaccccccgaaaugaaccccaacaaugggugcucccaaguuacucaggcagaaacauucacaaugugcaccuggcccccgcuguagcccccacuuucccgggcgagcagcuccucuuuuucagauccacuaugcccggaugcagcggguaccccaacauggacuuggacugucugcucccccaggaaugggugcaauacuucuaccaggaggcagccccagcacaaucugauguggcucuguuaagauuugugaauccagacacagguaggguucuguuugaguguaagcuucauaaaucaggcuauguuacaguggcucauacuggccaacaugauuugguuaucccccccaaugguuauuuuagauuugauuccugggucaaccaguucuucucccuugcccccaugggaaaugggacggggcgcagacgagcuuuauaa

SEQ ID NO: 5421 - RNA, 1623 nt, Artificial Sequence
  VP1__Norovirus__ALF12535
augaagauggcgucgagugacgccaacccaucuguuggguccgcagccaaccucgucccagaggucaacaaugagguuauggcucuggagcccguuguuggugccgccauugcggcaccuguggcgggccaacaaaauguaauugaccccuggauuagaaacaauuuuguacaagccccugguggagaguuuacaguguccccuagaaacgcuccaggugaaauacuauggagcgcgcccuuaggcccugaucuaaaucccuaccuaucccacuuggccagaauguacaaugguuaugcaggugguuuugaagugcugguaauccucgcggggaacgcguucaccgccgguaagaucauuuuugcagcagucccaccaaauuucccaacugaaggcuugagccccagccaggucacuauguucccccauauaauaguagauguuaggcaacuagaaccuguguugauucccuuacccgauguuaggaauaauuucuaccauuauaaucaaucaaaugaccccacuaucaaguugauagcaauguuguauacaccacuuagggcuaauaaugcuggggacgacgucuucacaguuucuugucggguucucacgagaccauccccugauuuugauuucauauuuuuagugccacccacaguugagucaagaacuaaaccauucucugucccaauuuuaacuguugaggagaugaccaauucaagauuccccauuccucuggaaaaguuguucacgggucccagcagugccuuuguuguucaaccacaaaacgguaggugcacgacugacggcgugcuccuagguacuacccaauugucuccugucaacaucugcaccuucagaggggaugucacccauacuacagguagucacaacuacacaaugaauuuggccacucaaaauuggaacaguuaugacccaacagaagaaaucccagccccucuaggaacuccagauuucguggggaagauucaagguguacucacccaaaccacaaagacagauggcucgacacgcggccacaaagcuacaguguacacugggagcgccgacuuugcuccaaaauuggguagaguucaauuugccacugacacagacaaugauuuugaagcuaaccaaaacacgaaguucaccccagucggugucauccaggauggugguacugcccaccgaaaugaaccccaacagugggugcucccaaguuacucaggcagaaauacucacaaugugcauuuggcccccgcuguagcccccacuuuuccgggugagcaacuucucuuuuucagauccacuaugcccggaugcagcggguaucccaacauggauuuggacugccugcucccccaggaaugggugcaguacuucuaccaagaggcagccccagcacaaucugauguggcucuacuaagauuugugaacccagacacagguaggguuuuguuugaguguaagcuucauaaaucaggcuauguuacaguagcucacacugguccacaugauuugguuaucccccccaaugguuauuuuagauuugauuccugggucaaccaguucuacacacuugcccccaugggaaaugggacggggcgcagacgagcuuuauaa

SEQ ID NO: 5422 - RNA, 1623 nt, Artificial Sequence
  VP1__Norovirus__ALF12536
augaagauggcgucgagugacgccaacccaucugaugggucugcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguguccccuaggaacgcuccaggugaaauacuauggagcgcgcccuuaggcccugaucuaaaucccuaccuaucccacuuggccagaauguacaaugguuaugcaggugguuuugaagugcaggugauccucgcggggaacgcguucaccgccgggaagaucauauuugcagcagucccaccaaauuucccaacugaaggcuugagccccagccaggucacuauguucccccauauaauaguagauguuaggcaacuagaacccguguugauucccuuacccgauguuaggaacaauuucuaccauuacaaucaaucaaaugaccccacuauuaaguugauagcaauguuguauacaccacuuagggcuaauaaugcuggggacgaugucuucacaguuucuugucgaguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccagcagugccuuuguuguucaaccacaaaacggcaggugcacgacugacggcgugcuccuagguacuacccaacugucuccugucaacaucugcaccuucagaggggaugucacccauacuacagguagucacaacuacacaaugaauuuggccacucaaaauuggagcaguuaugacccaacagaagaaaucccagccccucuaggaacuccagauuucguggggaagauucaagguguacucacccaaaccacaaagacagauggcucgacacgcggccacaaagcuacaguguacacugggagcgccgacuuugcuccaaaauuggguagaguucaauuugccacugacacagacaaugauuuugaagcuaaccaaaacacaaaguucaccccagucggugucauccaggaugguaauacugcccaccgaaaugaaccccaacagugggugcucccaaguuacucaggcagaaauacucacaaugugcauuuggcccccgcuguagcccccacuuuuccgggugagcaacuucucuuuuucagauccacuaugcccggaugcagcggguaucccaacauggauuuggacugucugcucccccaggaaugggugcaguacuucuaccaagaggcagccccagcacaaucugauguggcucuacuaagauuugugaacccagacacagguaggguuuuguuugaguguaagcuucauaaaucaggcuauguuacaguggcucacacugguccacaugauuugguuaucccccccaaugguuauuuuagauuugauuccugggucaaccaguuuuacacacuugcccccaugggaaaugggacggggcgcagacgagcauuauaa

SEQ ID NO: 5423 - RNA, 1623 nt, Artificial Sequence
  VP1__Norovirus__ALF12537
augaagauggcgucgagugacgccaacccaucugauggguccacagccaaccucgccccagaggucaacaaugagguuauggcuuuggagcccguaguuggugccgcuauugcggcaccuguagcgggccaaaaaaauguaauugaccccuggauuagaaacaauuuuguacaagccccugguggagaguuuacaguauccccuagaaacgcuccaggugaaauacuauggagcgcgcccuuaggcccugaucugaaucccuaccuuucccauuuggccagaauguacaaugguuaugcaggugguuuugaagugcagguaauccucgcggggaacgcguuuaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguacacaccacuuagggcuaauaaugccggggacgaugucuucacagucucuugucgaguucucacgagaccaucccccgauuuugauuucauauuuuuggugccacccacaguugaaucaagaacuaaaccauucucugccccaguuuuaacuguugaggagaugaccaauucaagguuccccauuccuuuggaaaaguuguucacgggccccaguagugccuuuguuguucaaccacaaaauggcaggugcacgacugauggcgugcuccuagguacuacccaacuguccccugucaacaucugcaccuucagaggggaugucacccauauuucaggcagucguaacuacacaaugaauuuggccucccaaaauuggaacaguuacgauccaacagaagaaaucccagcuccucuaggaacuccagauuucguggggaagauccaaggugugcucacccagaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacacucauaaugugcaccuggcccccgcuguagcccccacuuucccgggcgagcagcuccucuuuuucagaucuacuaugcccggaugcagcggguaccccaacauggauuuggacugucugcucccccaggaaugggugcaguauuucuaccaggaggcagccccagcacaaucugauguggcucuguuaagguuugugaauccagacacagguaggguuuuguuugaguguaagcuucauaaaucaggcuauguuacaguggcucacacuggccaacgugauuugguuaucccccccaaugguuauuuuagauuugauuccugggucaaccaguucuacucacuugcccccaugggaaaugggacggggcgccggcgugcauuauaa

SEQ ID NO: 5424 - RNA, 1623 nt, Artificial Sequence
  VP1__Norovirus__ALF12538
augaagauggcgucgagugacgccaacccaucugauggguccacagccaaccucgucccagaggucaacaaugagguuauggcuuuggagcccguuguuggcgccgccauugcggcaccuguagcgggccaacaaaauguaauugaccccuggauuagaaauaauuuuguacaagccccugguggagaguucacaguauccccuagaaacgcuccaggugaaauacuauggagcgcgcccuuaggcccugauuugaaucccuaccuuucccauuuggccagaauguacaaugguuaugcagguggcuuugaagugcagguaauccucgcggggaacgcguucaccgccgggaaaaucauauuuucagcagucccaccaaauuucccaacugaagguuugagccccagccaggucacuauguucccccacauaauaguggauguuaggcaauuagaaccuguguuaauccccuuacccgauguuaggaauaauuucuaucauuauaaucaaucaaaugaccccaccaucaaauugauagcaauguuguauacaccacuuagggcuaauaaugcuggggacgaugucuucacaguuuccugucgaguucucacgagaccaucccccgauuuugauuucauauucuuagugccacccacaguugaaucaagaaccaaaccauucucugucccaauuuuaacuguugaggagaugacuaauucaagguuccccauuccuuuggaaaaguuguucacgggccccaguagugccuuuguuguucaaccacaaaacggcaggugcucgacugauggcgugcuccuagguacuacccaacugucuccugucaacaucugcaccuuuagaggggaugucacccauauugcaggcagucauaacuacacaaugaaucuggcuucccaaaauuggagcaguuaugacccaacagaagaaaucccagccccucuaggaacuccagauuucguggggaagauucaaggugugcucacccaaaccacaaggucagaugguucgacccgcggccacaaagcuacaguguacacugggagugccgacuuuucuccaaaacuggguagaguucaauuugccacugacacagacaaugauuuuguaucuaaccaaaacacaaaguucaccccagucgguguuauccaggauggugauacugcccaccgaaaugaaccccaacaaugggugcuuccaaguuacucaggcagaaauauucauaaugugcaccuggcccccgcuguagcccccacuuuuccgggugagcaacuccucuucuuuagaucuaccauacccggaugcagcggguaccccaacauggauuuggacugccugcucccccaggaaugggugcaguauuucuaccaggaagcagccccagcacaaucugauguggcuuugcuaagauuugugaauccagauacagguaggguuuuguuugaguguaagcuucauaaaucaggcuauguuacaguggcucacacuggccaacaugauuugguuaucccccccaaugguuauuuuagauuugauuccugggucaaccauuucuacacacuugcccccaugggaaaugggacggggcgcagacgaguuuuauaa

SEQ ID NO: 5425 - RNA, 1623 nt, Artificial Sequence
  VP1__Norovirus__ALF12539
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaauaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccgcauaauaguagauguuaggcaauuggaaccuguguuaauccccuuacccgauguuaggaauaauuucuaucauuauaaucaaucaaaugaccccaccaucaaauugauagcaauguuguauacaccacuuagggcuaauaaugcuggggacgaugucuucacaguuucuugucgaguucucacgagaccaucccccgauuuugauuuuauauucuuagugccacccacaguugaaucaagaaccaaaccauucucugucccaauuuuaacuguugaggagaugacuaauucaagguuccccaucccuuuggaaaaguuguucacgggccccaguagugccuuuguuguucaaccacaaaacggcaggugcucgacugauggcgugcuccuagguacuacccaacugucuccugucaacaucugcaccuucagaggggaugucacccauauugcaggcagucauaacuacacaaugaaucuggcuucccaaaauuggagcaguuaugacccaacagaagaaaucccagccccucuaggaacuccagauuucguggggaagauucaaggugugcucacccaaaccacaaggacagauggcucgacccgcggucacaaagcuacaguguacacugggagugccgacuuuucuccaaaacuggguagaguucaauuugccacugacacaaacaaugauuuugaaucuaaccaaaacacaaaguucgccccagucgguguuauccaggauggugguacugcccaccgaaaugaaccccaacaaugggugcuuccaaguuacucaggcagaaauauucauaaugugcaccuggcccccgcuguggcccccacuuuuccgggugagcaacuccucuucuuuagaucuaccauacccggaugcagcggguaccccaacauggauuuggacugccugcucccccaggaaugggugcaguacuucuaccaggaagcagccccagcacaaucugauguggcucugcuaagguuugugaauccagacacagguaggguuuuguuugaguguaagcuccauaaaucaggcuauguuacaguggcucacacuggccaacaugauuugguuaucccccccaaugguuauuuuagauuugauuccugggucaaccaguucuacacacuugcccccaugggaaaugggacggggcgcagacgagcuuuauaa

SEQ ID NO: 5426 - RNA, 1623 nt, Artificial Sequence
  VP1__Norovirus__ALF12541
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucguggggaaugcguucaccgccgggaaaaucauauuugcagcagucccaccaaauuucccaacugaagguuugagccccagucaagucacuauguucccccacauaauaguagauguuaggcaauuggaaccuguguugaucccccuacccgauguuaggaauaauuucuaccauuauaaccagucaagugacuccaccaucaaauugauagcaauguuguacacaccacuuagggcuaacaaugcuggggacgaugucuucacaguuucuugucgaguucucacgagaccaucccccgauuuugauuuuauauuuuuggugccacccacaguugaaucaagaacuaaaccauucucugucccaguuuuaacuguugaggagaugaccaauucaagguuccccauuccuuuggaaaaacuguucacgggucccaguagugccuuuguuguucaaccacaaaacggcaggugcacgacugauggcgugcuccuagguacuacccaacugucuccugucaacauuugcaccuucagaggggaugucacccacauuucaggcagucauaacuacacaaugaauuuggccucccaaaauuggaacaguuacgauccaacagaagaaaucccagccccccuaggaacuccagauuucguggggaagauucaagguguacucacccagaccacaaggacagauggcucaacccgcggccacaaagcuacaguguacacugggagcaccgacuuuacuccaaaacuggguagggcucaauuugccacugacacagacaaugauuuugaaacuaaucaaaacacaaaguucaccccagucgguguuauccaggauggugguacuacccaccgaaaugaaccccaacaaugggugcucccaaguuacucgggcagaaacacucauaacgugcaccuggcccccgcuguagcccccacuuucccgggcgagcagcuucucuucuucagaucuaccaugcccggaugcagcggguaccccaacauggauuuggacugucugcucccccaggaaugggugcaguauuucuaccaggaggcagccccagcacaaucugauguggcauuauuaagauuugugaauccagacacagguaggguuuuguuugaguguaagcuucauaaaucaggcuauguuacaguggcucauacuggccaacaugauuuaguuaucccccccaaugguuauuuuagauuugauuccugggucaaccaguucuacacacuugcccccaugggaaaugggacggggcgcagacgugcuuuauaa

SEQ ID NO: 5427 - RNA, 1623 nt, Artificial Sequence
  VP1__Norovirus__ALF12542
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguguccccuagaaacgcuccaggugaaauauuguggagcgcacccuugggcccugaucuaaaucccuaccuaucccauuuggccagaauguauaaugguuaugcaggugguuuugaagugcagguaauccucgcggggaacgcguucaccgccgggaagguuauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggacgaugucuucacaguuucuugccgaguucucacgagaccaucccccgauuuugauuucauauuucuagugccacccacaguugagucuagaacuaaaccauucucugucccaguuuuaacuguugaggagaugacuaauucaagauuccccauuccuuuggaaaaguuguucacgggucccagcagugccuuuguuguucaaccacaaaacgguaggugcacgacugauggcgugcuccuaggcaccacccaauugucuccugucaacaucugcaccuucagaggggaugucacccacaucacagguagucguaacuacacaaugaauuuggcuucucaaaauuggaacaauuaugacccaacagaagaaaucccagccccucuaggagcuccagauuuuguggggaagauucaaggcaugcucacccaaaccacaagggcagauggcucaacacgcggccacaaagcuacaguguacacugggagcgccgacuuugcuccaaaacugggcaggguucaauuugaaacugacacagaccaugauuuugaagcuaaccaaaacacaaaguucaccccagucggugucauccaagaugguagcaccacccaccgaaaugaaccccaacagugggugcucccaaguuacucaggcaggaauacucauaauguucaucuggcccccgcuguagcccccacuuuuccgggugagcaacuucucuucuuuagauccaccaugcccggguguagcggguaccccaacauggauuuggacugucugcucccccaggaaugggugcaguacuucuaccaagaggcagcuccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguucuacacgcuugcccccaugggaaauggagcggggcguagacgagcauuauaa

SEQ ID NO: 5428 - RNA, 1623 nt, Artificial Sequence
  VP1__Norovirus__ALF12543
augaagauggcgucgagugacgccaacccaucugauggguccgcagccaaccucguaccagaggucaacaaugagguuauggcuuuggagcccguuguuggugccgcuauugcggcaccuguagcgggccaacaaaauguaauugaccccuggauuagaaacaauuuugugcaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaagaucauauuugcagcagucccaccaaauuuuccaacugaaggcuuaagccccagccaggucacuauguucccccauauaauaguagauguuagacaacuagaaccugugcugauucccuuacccgaugucaggaauaauuucuaucauuacaaucaaucaaaugacuccacuauuaagcugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccacaaaacggcaggugcacgacugauggcgugcuccuagguaccacccaacugucuccugucaacaucugcacuuucagaggggacgucacccacaucacagguagucguaacuacacaaugaauuuggcuucucaaaauuggaacaauugugacccaacagaagaaaucccagccccucuaggaacuccagauuuuguggggaagauucaaggcaugcucacccaaaccacaaggacagaugguucaacacgcggccacaaagcuacaguguacacugggagugccgacuuugcuccaaaacugggcagaguucaauuugaaacugacacagaccaugauuuugaagcuaaccaaaacacaaaguucaccccagucggugucauccaagaugguagcaccacccaccgaaaugaaccccaacaguggguacucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucaggcuauguuacaguggcucacacuggccaacaugauuuggucaucccccccaaugguuacuuuagguuugauuccugggucaaccaguucuacacgcuugcccccaugggaaauggaacggggcguaggcgagcauuauaa

SEQ ID NO: 5429 - RNA, 1623 nt, Artificial Sequence
  VP1__Norovirus__ALF12546
augaagauggcgucgagugacgccaacccaucugaaggguccacagccagccucgucccagaggucaacaaugaggucauggcuuuggagcccguagcuggugccgccauugcggcaccuguagcgggccaaguaaauguaauugaccccuggauuagaaauaauuuuguacaagccccugguggagaguuuacaguguccccuagaaacgcuccaggugaaauacuauggagcgcgcccuuaggcccugauuugaaucccuaccuuucucauuuggccagaauguacaaugguuaugcaggugguuuugaagugcagguaauccucgcggggaacgcguucaccgccggaaaaaucauauuugcagcagucccaccaaauuucccaacugaagguuugagccccagucaggucacuauguucccccacauaauaguagauguuaggcaauuggaaccuguguugauccccuuacccgauguuaggaauaauuucuaccauuauaaucaaucaaaugaacccaccaucaaauugguagcaauguuguauacaccacuuagggcuaacaaugccggggacgaugucuucacagucucuugucgaguacucacgagaccaucccccgauuuugauuucauauuuuuggugccacccacaguugaaucaagaacuaaaccauucucugucccaauuuuaacuguugaggagaugaccaauucaagguuccccauuccucuggaaaaguuguucacgggccccaguaguuccuuugucguucaaccacaaaacggcaggugcacgacugauggcgugcuccuagguaccacccaacugucuccugucaacaucugcaccuucagaggggaugucacccauauuucaggcagucguaaccacacaaugaauuuggccucccaaaauuggaacaguuacgauccaacagaagaaaucccagccccucuaggaacuccagauuucguggggaagauucaaggugugcucacccaaaccacaaggucagauggcucgacccgcggccacaaagcuacgguguacacugggagcgccgacuuuucuccaaaacuggguagaauucaauuugccacugacacagacaaugauuuugaaacuaaccaaaacacaaaguucaccccagucgguguuauccaggauggugguacuacccaccgaaaugaaccccaacaaugggugcucccaacuuacucaggcagaaacacccauaaugugcaccuggcccccgcuguagcccccacuuucccgggcgagcagcuccucuucuucagaucuaccaugcccggguguagcggguaucccgacauggacuuggacugucugcucccccaggagugggugcagcacuucuaccaggaggcagccccagcacaaucugauguggcucuguuaagauuugugaauccagacacagguaggguuuuguuugaguguaagcuccauaaggcaggcuauguuacaguggcucacacuggccaacaugauuugguuaucccccccaaugguuauuucagauuugauuccugggucaaccaguucuucacacuugcccccaugggaaaugggacggggcgcagacgagcuuuauaa

SEQ ID NO: 5430 - RNA, 1623 nt, Artificial Sequence
  VP1__Norovirus__ALF12547
augaagauggcgucgagugacgccaacccaucugauggguccgcagccaaccucguaccagaggucaacaaugagguuauggcuuuggagcccguuguuggugccgcuauugcggcgccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaagaucauauuugcagcagucccaccaaauuuuccaacugaaggcuuaagccccagccaggucacuauguucccccauauaauaguagauguuagacaacuagaaccugugcugauucccuuacccgacguuaggaauaauuucuaucauuauaaucaaucaaaugaccccacuauuaaguugauagcaauguuguauacaccacuuagggcuaauaaugcuggggacgaugucuucacaguuucuugcagaguucucacgagaccaucccccgauuuugauuucauauuuuuagugccacccacaguugagucaagaacuaaaccauucucugucccaguuuuaacuguugaggagaugacuaauucaagauuccccauuccuuuggaaaaguuguucacgggccccagcagugccuuuguuguucaaccacaaaacggcaggugcacgacugauggcgugcuccuaggcaccacccaacugucuccugucaacaucugcaccuucagaggggaugucacccacaucacagguagucguaacuacacaaugaauuuggcuucucaaaauuggaacaauuaugacccaacagaagaaaucccagccccucuaggaacuccagauuuuguggggaagauucaaggcaugcucacccaaaccacaaggacagaugguucaacacgcggccacaaagcuacaguguacacugggagugccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaagugcucauaaugugcaucuggcccccgcuguagcccccacuuuuccgggugagcaacuucucuucuucagauccaccaugcccggaugcagcggguaccccaacauggauuuggacugucuacucccccaggaauggguacaguacuucuaccaagaggcagccccagcacaaucugauguggcucugcuaagauuugugaauccagacacagguaggguuuuguuugaguguaagcuacacaaaucaggcuauguuacaguggcucacacuggccaacaugauuugguuaucccccccaaugguuacuuuagauuugauuccuggguuaaccaguucuauacgcuugcccccaugggaaauggaacggggcgcagacgugcauuauaa

SEQ ID NO: 5431 - RNA, 1623 nt, Artificial Sequence
  VP1__Norovirus__ALF12560
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaagcaauuuuguacaagccccugguggagaguuuacaguauccccuagaaacgcuccaggugaaauacuauggagcgcgcccuuaggcccugauuugaaucccuaucuuucccacuuggccagaauguacaaugguuaugcaggugguuuugaagugcagguaauccucgcggggaacgcguucaccgccgggaaaaucauauuugcagcagucccaccaaauuucccaacugaaggucugagccccagccaggucacuauguucccccacauaauaguagauguuaggcaauuagaaccuguuuugauccccuuacccgauguuaggaauaauuucuaucacuauaaccaaucaaaugaccccaccaucaaauugauagcaauguuguauacaccacuuagggcuaauagugcuggggacgaugucuucacgguuucuugucgaguucucacgaggccaucucccgauuuugauuuuauauuuuuagugccacccacaguugaaucaagaacuaaaccauucucugucccaauuuuaacuguugaggagaugaccaauucaagguuccccaucccuuuggaaaaguuguucacgggccccaguagugccuuuguuguucaaccacaaaacggcaggugcacgacugauggcgugcuccuagguacuacccaacugucucccgucaacaucugcuccuucagaggggaugucacccauauugcaggcagucguaacuacacaaugaaccuggcuucccaaaauuggaacaguuaugauccaacagaagaaaucccagccccucuaggaaccccagauuucguggggaagauccaaggugugcucacccaaaccacaaggacagaugguucgacccgcggccacagagcuacaguguacacugggagcgcugacuuuucuccaaaacuggguagaguucaauuugccacugacacagacaaugauuucguugcuaaccaaaacacaaaguucaccccagucgguguuauccaggauggugauacugcccaccgaaaugaaccccaacaaugggugcucccaaguuacucaggcagaaauauucauaaugugcaccuggcccccgcuguagcccccacuuuuccgggugagcaacuccucuucuucagauccaccaugcccggaugcagcggguaccccaacauggauuuggacugucugcucccccaggaaugggugcagcauuucuaccaggaagcagccccagcacaaucugauguggcuuugcuaagauuugugaauccagacacagguaggguucuguuugaguguaagcuucauaaaucaggcuauguuacaguggcucacacuggccaacaugauuuaguuaucccccccaacgguuauuuuagauuugacuccugggucaaccaauucuacacacuugcccccaugggaaaugggacggggcguagacgugcauuguaa

SEQ ID NO: 5432 - RNA, 1623 nt, Artificial Sequence
  VP1__Norovirus__ALF12562
augaagauggcgucgagugacgccaacccaucugauggguccacagccaaccucgucccagaggucaacaaugagguuauggcuuuggagcccguaguuggugccgcuauugcggcaccuguagcgggccaacaaaauguaauugaccccuggauuagaaacaauuuuguacaagccccugguggagaguuuacaguauccccuagaaacgcuccaggugaaauacuauggagcacgcccuugggcccugauuugaaucccuaccuuucccauuuggccagaauguacaaugguuaugcaggugguuuugaagugcaggugauccucgcggggaaugcguucaccgcugggaaaaucauauuugcagcagucccaccaaauuucccaacugaagguuugagccccagccaagucacuauguucccccacauaauaguagauguuaggcaauuggaaccuguguugauccccuugcccgauguuaggaauaauuucuaccauuauaaucagucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucuguaccuucagaggggaugucacccacauuucaggcagucguaacuacacaaugaauuuggccucccaaaauuggaacaguuacgauccaacagaagaaaucccagccccccuaggaacuccagauuucguggggaagauucaaggugugcucacccaaaccacaagaacagauggcucgacccgcggccacaaagcuacaguguacacugggagcgccgacuuuucuccaaaacuagguaggguucaauuugccacugacacagacaaugauuuugaaacuaaccaaaacacaaaguucaccccagucgguguuauccaggaugguagcaccacccaccgaaaugaaccccaacaaugggugcucccaaguuacucaggcagaaacacucauaaugugcaccuggcccccgcuguagcccccacuuucccgggcgagcagcuccucuucuucagaucuaccaugcccggauguagcggguaccccaacauggauuuggacugucugcucccccaggaaugggugcaguauuucuaccaggaagcagccccagcacaaucugauguggcacuguuaagguuugugaauccagacacagguaggguuuuguuugagugcaagcuucauaaaucaggcuauguuacaguggcucacacuggccaacaugauuuaguuaucccccccaauggcuauuuuagauuugauuccugggucaaccaguucuacacacuugcccccaugggaaaugggacggggcguagacgugcauuauaa

SEQ ID NO: 5433 - RNA, 1623 nt, Artificial Sequence
  VP1__Norovirus__ALF12564
augaagauggcgucgagugacgccaacucaucugauggguccgcagccaaccucgucccagaggucaacaaugagguuauggcucuggagcccguuguuggugccgccauugcggcaccuguggcgggccaacaaaauguaauugaccccuggauuagaaauaauuuuguacaagccccugguggagaguuuacagugucccccagaaacgcuccaggugaaauacuauggagcgcgcccuuaggcccugaucuaaaucccuaccuaucccacuuggccagaauguacaaugguuaugcaggugguuuugaagugcagguaauccucgcggggaacgcguucaccgccgguaagaucauuuuugcagcagucccaccuaauuucccaacugaaggcuugagccccagccagguuacuauguucccccauauaauaguagauguuaggcaacuagaaccuguguugauucccuuacccgauguuaggaauaauuucuaccacuauaaucaaucaaaugaccccacuaucaaguugauagcaauguuguauacaccacuuagggcuaauaaugcuggggacgaugucuucacaguuucuugucggguucucacgagaccauccccugauuuugauuucauauuuuuagugccacccacaguugagucaagaacuaaaccauucucugucccaauuuuaacuguugaggagaugaccaacucaagauuccccauuccuuuggaaaaguuguucacgggucccagcagugccuuuguuguucaaccacaaaacggcaggugcacgacugacggcgugcuccuaggcacuacccaauugucuccuguuaacaucugcaccuucagaggggaugucacccauauuacagguagucgcaauuacacaaugaauuuggccacucaaaacuggaacagcuaugacccaacagaagagaucccagccccucuaggaacuccagauuucgugggaaagauucaagguguacucacccaaaccacaaagacagauggcucgacacgcggccacaaagcuacaguguacacugggagcgccgacuuugcuccaaaauuggguagaguccaauuugccacugacacagacaaugauuuugaagcuaaccaaaacacaaaguucaccccagucggugucauccaggauggugguacuacccaccgaaaugaaccccaacagugggugcucccaaguuacucaggcagaaauacucacaaugugcauuuggcccccgcuguagcccccacuuucccgggugagcaacuucucuucuucagauccacuaugcccggaugcagcggguaucccaacauggauuuggacugccugcucccccaggaaugggugcaguacuucuaccaagaggcagccccagcacaaucugauguggcucuacuaagauuugugaacccagacacagguaggguuuuguuugaguguaagcuucauaaaucaggcuauguuacaguagcucauacugguccacaugauuugguuauccccccaaaugguuauuuuagauuugauuccugggucaaccaguuuuacacacuugcccccaugggaaaugggacggggcguagacgugcaacauaa

SEQ ID NO: 5434 - RNA, 1623 nt, Artificial Sequence
  VP1__Norovirus__ALF12566
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagagacaauuuuguacaagccccugguggggaguuuacaguauccccuagaaacgcuccaggugaaauacuauggagcgcgcccuuaggcccugauuuaaaucccuaccuaucccauuuggccagaauguacaaugguuaugcaggugguuuugaagugcagguaauccucgcggggaacgcguucaccgccgggaaggucauauuugcagcagucccaccaaauuuuccaacugaaggcuuaagccccagccagguuacuauguucccccauaugauaguagauguuaggcaacuagaaccugugcugauucccuuacccgauguuaggaauaauuucuaucauuacaaucaaucaaaugaccccacccuuaaguugauagcaauguuguauacaccacuuagggcuaauaaugcuggggacgaugucuucacaguuucuugccgaguccucacaagaccaucccccgauuuugauuucauauucuuggugccacccacaguugagucaagaacuaaaccauucucugucccaguuuuaacuguugaggagaugaccaauucaagguuccccauuccuuuggaaaaguuguucacgggucccagcagugccuuuguuguucaaccacaaaacggcaggugcacgacugauggcgugcuccuaggcaccacccaacugucuccugucaacaucugcaccuucagaggggaugucacccauaucacaggcagucguaacuacacaaugaauuuggcuucucaaaauuggaacaauuaugacccaacagaagaaaucccagccccccuaggagcuccagauuuuguggggaagauucaaggcaugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcacacacuggccaacaugauuugguuaucccccccaaugguuauuuuagguuugauucuugggucaaccaguucuacacgcuugcccccaugggaaauggaacggggcguagacguauaguauaa

SEQ ID NO: 5435 - RNA, 1623 nt, Artificial Sequence
  VP1__Norovirus__ALF12569
augaagauggcgucgagugacgccaacccaucugauggguccgcagccaaccucguaccagaggucaacaaugagguuauggcuuuggagcccguuguuggugccgcuauugcggcaccuguagcgggccaacaaaauguaauugaccccuggauuagaaacaauuuuguacaagccccugguggagaguuuacaguguccccuagaaacgcuccaggugaaauacuauggagcgcgcccuuaggcccugaucuaaaucccuaccuaucccauuuggccagaauguauaaugguuaugcaggugguuuugaagugcagguaauucucgcggggaacgcguucaccgccgggaagaucauauuugcagcagucccaccaaauuuuccaacugaaggcuuaagccccagccaggucacuauguucccccauauaauaguagauguuagacagcuagaaccugugcugauuccccuacccgaugucaggaauaauuucuaucauuacaaucaaucaaaugauuccacuauuaaguugauagcaauguuguauacaccacuuagggcuaauaaugcuggggacgaugucuucacagucucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccacaaaacggcaggugcacaacugauggcgugcuccuaggcaccacccaacugucuccugucaacaucugcaccuucagaggggaugucacccacaucacagguagucguaacuacacaaugaauuuggcuucucaaaauuggaacaauuaugacccaacagaagaaaucccagccccucuaggaacuccagauuuuguggggaagauucaaggcaugcucacccaaaccacaaggacagaugguucaacacgcggccacaaagcuacaguguacacugggagugccgacuuugcuccaaaacuggguagaguucaauuugaaacugacacagaccaugauuuugaagcuaaccaaaacacaaaguucaccccagucggugucauccaagaugguagcaccacccaccggaaugaaccccaacagugggugcucccaaguuacucaggcagaaauacucauaaugugcaucuggcccccgcuguagcccccacuuuuccgggugagcaacuucccuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucaggcuauguuacaguggcucacacuggccaacaugauuugguuaucccccccuaugguuacuucagguuugauuccugggucaaccaguucuacacgcuugcccccaugggaaauggaacggggcguaggcgagcuuuauaa

SEQ ID NO: 5436 - RNA, 1623 nt, Artificial Sequence
  VP1__Norovirus__ALQ28762
augaagauggcgucgaaugacgccgcuccaucuaaugauggugcugcuggucucguaccagagggcaauaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuuugugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 5437 - RNA, 1632 nt, Artificial Sequence
  VP1__Norovirus__ALS03883
augaagauggcgucgaaugacgccgcuccaucuaaugauggugcagccggucucguaccagagaucaacaacgagacaauggcuuuggaaccaguggcaggaggagcaauugcagccccacuaacuggacaaacaaauuucauugaucccuggauuagagguaauuaugugcaagcaccaaauggugaauuuacagugucccccagaaauucgcccggugaaauuuugcuuaauuuagaauuaggcccugaacucaacccauucuugucccaucuaucuagaauguacaauggguaugcuggcgguaucgauguccaagucaucauggcaggcaaugccuucaccgcugguaagaucaucuuugcagcaauaccuccccacuuccccguggaaaaucuuagucccccucagaucacuauguucccucauauuauaguggaugucaggacccuugaacccauaaauaucccuguaccagauguuaggaacaacuucuuccauuauaaccaaaacaaugagucucgcaugagacugguggccauguuguacaccccucuuaggucuaaugggucugcugaagauguuuucacagugucauguagggucuuaacaaaaccaucugcagacuuugaauuuaauuaucuaguccccccaacuguagagucaaggacuaaacccuucacaauaccaauacucacaauuggggaaaugacaaauucaagauucccagugccuauugacaugcuucauaccaguccaacagaaaacauuguuguucaaccacaaaaugguagguguaccauagauggugaguugcuuggcaccacucaacugaucacuuccaauaucuguucauucagaggauccaucucagggcaugaaggcaaugaugaccaacaccuguggcacuucaacaucacaaaccccaauggcacuccauuugaccccacugaagaugugccugccccccucggaaccccagauuucaggggucaauuguacggugucaucucccagcgagauagagagggaacacccucggaaaauaaucagaaggcaaacaggucccaccagggagugauuucaacaaucucaccaaaauuuguccccaaguuagguucagucaugauuggcacauggacuacugaugauaucaagaaccagccauccaaguucaccccaauuggccucaaugaugaugauaauuuuaaacaaugggaacugccaaauuauucuggggcgcucacccucaacaugggguuggcaccuaguguuuuccccaccuauccuggugaacaaauccuuuucuuccgcuccuaucugccauugaagggaggguacgguaguccauuuauugacugccuaguaccucaagaaugggucgcucacuucuaccaggagucagcacccgcacaaacagauguggcccuaaucagguauguaaaccccgaaacaggacguguccuuuucgaggccaaauugcacagacagggguucaucaccguugccaagagcggcgacagccccaucaaugugccugccaaugguuauuuuagguuugauucuugggucaaucaguuuuacucucuugcccccaugggaacugggaacgggcgcagaaggauucaguaa

SEQ ID NO: 5438 - RNA, 1617 nt, Artificial Sequence
  VP1__Norovirus__ALT06546
augaagauggcgucgaaugacgccgcuccaucuaaugauggugcugcuggucucguaccagagggcaacaacgagacccuuccccuagaaccaguugcgggcgcagcuauagccgcaccugucacuggccaaaacaacauaauugaccccuggauuagaacaaauuuugugcaagcaccaaauggagaguucacagugucacccaggaacuccccuggagaaauuuuacuaaaccuagaguugggcccugauuugaacccuuauuuggcucauuugucaaggauguacaauggguaugcuggaggaguggaaguucagguucuccuggcagggaacgcguucacugccggaaagauccucuucgccgccgucccgccaaauuucccaguggaauucuugagcccagcccagauuacaaugcucccacauuuaauaguagaugucaggacucuugaaccaauuaugaucccacucccugauguucggaauacauucuuccauuauaacaaccagccuaacagccgcaugagauuaguggcuaugcucuacaccccccuuagaucuaauggcucaggugaugaugucuuuacuguuucuugcaggguuuugacuaggccuacuccugauuuugaguucacuuauuuagugccaccuucuguugaaucuaagacuaagccuuuuuccuuaccuauuuuaacccuuucugagcucacaaauucgagguucccaguccccaucgauucgcuuuucaccgcccaaaauaauguguugcaggugcagugucaaaauggcaggugcacacuugauggugaguuacaaggcacaacccaguugcucccaucuggcaucugugcauucagaggacgggugacagcagaaacugaccaucgugacaaguggcacaugcaacugcaaaaccucaaugguacaacauaugacccaacugaugaugugccagccccgcuggguacaccugacuucaagggcguuguguuugggauggcaagucaaagaaauguggguaaugaugcgccuggcucaaccagggcucaugaggcgguaauuucaaccuauagcccccaauuuguccccaaauuagguucuguuaauuuuagaagcaaugauaaugauuuccaauugcagccaacaaaauucacaccagugggcaucaaugacgauggugaccacccguucagacaaugggaacuaccagacuauucagggccgcuuaccuugaauaugaaccuugcccccccgguugcgccaaauuucccuggugaacaauuauuauucuucagaucuuuugugccaugcucaggagguuauaaccaaggcauuguagauugucuuaucccccaagaauggauccaacacuucuaucaggaaucagcgccuucccagucagauguggcccuaaucagguauguuaaccccgacacagggcgcacacuguuugaagcaaaauugcacagaucugguuacauuacuguggcucacucuggagacuauccucuuguuguuccggccaauggauacuuuagauuugauucuuggguaaaucaguuuuacucacucgccccaaugggaacugggaaugggcgaaggagggcucaguaa

SEQ ID NO: 5439 - RNA, 1647 nt, Artificial Sequence
  VP1__Norovirus__BAG30939
augaagauggcgucgaaugacgccacuccaucuaaugauggugccgccggccucgucccagagaucaacaaugaggcaauggcgcuagauccaguggcgggugcagcgauagcagcaccccucacuggccagcaaaauauaauugaucccuggauuaugaauaauuuugugcaagcaccugguggugaguuuacaguauccccuaggaauuccccuggugaagugcuucuuaauuuggaauugggcccagaaauaaaucccuauuuggcacaucucgcuagaauguauaaugguuaugcagguggauuugaagugcagguaguccuagcuggaaaugcguuuacagcaggaaagauaaucuuugcagcuauacccccuaauuucccaauugauaaucuaagcgcacgacagauuacaaugugcccacaugugauuguggaugucagacaguuggaaccagucaaccucccgaugccugacguucgcaacaauuucuuucauuauaaccaaggaucugauucgagauugcgcuuaauugcaaugcuguacacaccucuuagggcaaauaauucuggggaugauguuuuuacugugucuuguagagugcugacuaggccuagcccugacuucucauucaauuuccuugugccacccacuguggagucaaagacaaaacccuucacccucccuauucugacuaucucugaaauguccaauucuagguuuccagugccgauugacucucugcacaccagcccaacugagaauauuguuguccagugccaaaaugggcgcgucacucuugauggugagcugaugggcaccacccaacucuuaccuagucaaaucugugcuuucaugggcgugcucaccaggucaacaagcagggccagugaucaggccgacacagcaaccccuagguuguuuaauuauuauuggcauauacaauuggauaauccaaaugggacuccuuaugauccugcagaagacauaccaggcccccuagggacaccagauuuccggggcaaagucuuuggcguggccagccagagaaaccccgacagcacaacuagagcacaugaagcaaagguggacacaacagcuggucguuucaccccaaaacuaggcucauuagagauauccacugaaucugaugacuuucaucaaaaccaaccaacaagauucaccccaguuggcauugggguugacaaugaagcagacuuucaacaguggucuuuacccgacuauucuggucaguucacccacaacaugaacuuagccccagcuguugcucccaacuucccuggagagcagcuccuuuucuuccgcucacaguuaccauccucuggugggcgauccaacgggauucuagacugccuggucccucaagaguggguucagcacuucuaccaagaaucggcccccucucaaacucaaguggcccugguuagguaugucaacccugacacuggcagaguauuauuugaggccaagcugcacaaauuagguuucaugacuauagcuaagaauggugacucuccaauaacugucccuccaaauggauacuuuagguuugaaucuugggugaacccauuuuacacacuugcccccaugggaacugggaaugggcguagaaggauucaauaa

SEQ ID NO: 5440 - RNA, 1623 nt, Artificial Sequence
  VP1__Norovirus__BAG70428
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuacuauuaaauugauagcaaugcuguauacaccacuuagggccaauaaugcuggggaagaugucuucacagucucuugucgaguccucacgaggccguccccugauuuugacuuuauauuuuugguaccacccacaguugagucaagaacuaaaccauuuacugucccaaucuuaacuguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacggaagaaauuccagccccucuaggaacuccagauuucgugggaaagauccaaggugugcucacucaaaccacaaagggagauggcucgacccguggccauaaggcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaaugugcaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5441 - RNA, 1623 nt, Artificial Sequence
  VP1__Norovirus__BAG70431
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggcgccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguucgauuccuggguuaaucaauucuacacacuugcccccaugggaaauggaacggggcguagacgugcuuuauaa

SEQ ID NO: 5442 - RNA, 1623 nt, Artificial Sequence
  VP1__Norovirus__BAG70434
augaagauggcgucgaaugacgccaacccaucugauggguccgcagccaaccucgucccagaggucaacaaugaggucauggcuuuggagcccguugucggugccgcuauugcagcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccaucccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaauaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaaugcccauaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5443 - RNA, 1623 nt, Artificial Sequence
  VP1__Norovirus__BAG70437
augaagauggcgucgaaugacgccaacccaucugauggguccacagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcaaaagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaacugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcaggugcacgacugauggcgugcucuuaggcaccacucaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5444 - RNA, 1623 nt, Artificial Sequence
  VP1__Norovirus__BAG70440
augaagauggcgucgaaugacgccaacccaucugauggguccacagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccaggauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaccagucaaaugauucuaccauuaaauugauagcaaugcuguauacaccacuuagggcuaauaaugcuggggaugacgucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaagcuucauaaaucaggcuauguuacaguggcuuacaccggccagcaugauuuggucaucccccccaauggcuauuuuagguuugauuccuggguuaaucaauucuacacacuugcccccaugggaaauggaacggggcguagacgugcucuauaa

SEQ ID NO: 5445 - RNA, 1623 nt, Artificial Sequence
  VP1__Norovirus__BAG70446
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccauuuggccagaauguacaauaguuaugcaggugguuuugaagugcagguaauccuugcggggaacgcguucaccgccggaaaaaucauauuugcagcagucccaccaaauuucccaacugaaggcuugagccccagccaggucacuauguucccccauauaauaguagauguuaggcaacuggaaccuguguugauuccuuuacccgauguuaggaauaauuucuaucacuacaaucaaucaaacgaccccaccaucaaauugauagcaauguuguacacaccacuuagggcuaauaaugcuggggacgaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccagcagugccuuuguuguucaaccacaaaauggcaggugcacgacugauggcgugcucuuagguacuacccaacugucuccugucaacaucugcaccuucagaggggaugucacccacauugcugguacucaagaauacacaaugaaucuggccucccaaaacuggaacaauuaugacccaacagaagaaaucccagccccucugggaacuccagauuucguggguaagauccaaggcgugcucacccaaaccacaaggagggauggcucgacccgcggucacaaagccacagugagcacuggaaguguccacuucaccccaaagcugggcagaauucaauucuccacugauacaagcaaugauuuugaaacuggccaaaacacgagauucaccccagucgguguuguccaggaugguaguaccacccaccaaaaugaaccccaacaauggguacucccaaauuauucagguagagauagucacaaugugcaccuagccccugccguggcccccucuuuuccgggugagcaacuucuuuucuucagguccacuaugcccggaugcagcggguaucccaacaugaauuuggauugucuacucccccaggagugggugcagcacuucuaccaagaggcagccccagcacaaucugauguggcucugcuaagauuugugaauccagacacagguaggguuuuguuugaguguaagcuucauaaaucaggcuaugucacaguggcucacacuggccaacaugauuuaguuaucccccccaauggcuauuuuagauuugauuccugggucaaccaguucuacacacuugcccccaugggaaaugggacggggcguagacgugcauuauaa

SEQ ID NO: 5446 - RNA, 1623 nt, Artificial Sequence
  VP1__Norovirus__BAG70449
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuugggcccugauuugaaucccuaccuuucccauuuggccagaauguacaauaguuaugcaggugguuuugaagugcagguaauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugaccccaccaucaaauugauagcaauguuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccaguggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacccaccaaaacacaaaauucaccccagucggugucauccaggaugguagcaccacccaccgaaaugaaccccaacaaugggugcucccaaguuacucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5447 - RNA, 1623 nt, Artificial Sequence
  VP1__Norovirus__BAG70452
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucaguuaaaugauucuaccauuaaacugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccaguggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacccaccaaaacacaaaauucaccccagucggugucauccaggaugguagcaccacccaccgaaaugaaccccaacaaugggugcucccaaguuacucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5448 - RNA, 1623 nt, Artificial Sequence
  VP1__Norovirus__BAG70458
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccagguuacuauguucccccacauaauaguagauguuaggcaauuggaaccuguguugauccccuuaccugauguuaggaauaacuucuaucacuauaaucagucaaaugauucuaccauuaaacugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuucccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugaaugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5449 - RNA, 1623 nt, Artificial Sequence
  VP1__Norovirus__BAG70461
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccuuuaggaacuccagauuucgugggaaagauccaaggugugcucacucaaaccacaaagggagauggcucgacccguggccauaaagcuacaguuuacacugggagugcccccuuuacuccaaagcugggcaguguucaguucaguacugauacagaaaaugauuuugaaacucaccaaaacacaaaauucaccccagucggugucauccaggaugguagcaccacccaccgaaaugaaccccaacaauggguacucccaaguuauucagguagaaauguccaaaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuccauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5450 - RNA, 1623 nt, Artificial Sequence
  VP1__Norovirus__BAG70464
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaguucaguacugauacagaaaaugauuuugaaacucaccaaaacacaaaauucaccccagucggugucauccaggaugguagcaccacccaccgaaaugaaccccaacaauggguacucccaaguuauucagguagaaauguccaaaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuccauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5451 - RNA, 1623 nt, Artificial Sequence
  VP1__Norovirus__BAG70467
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaguucaguacugauacagaaaaugauuuugaaacucaccaaaacacaaaauucaccccagucggugucauccaggaugguagcaccacccaccgaaaugaaccccaacaaugggugcucccaaguuauucagguagaaauguccaaaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuccauaaaucaggcuaugucacaguggcucacaccggucagcaugauuuggucaucccccccaaugguuauuuuagguuugauuccuggguuaaucaauucuacacacuugcccccaugggaaauggaacggggcguagacgugcuuuauaa

SEQ ID NO: 5452 - RNA, 1623 nt, Artificial Sequence
  VP1__Norovirus__BAG70470
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaggugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaacaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuagguaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccgcggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccucaggagugggugcagcacuucuaccaagaggcagcuccagcacaaucugauguggcucuauugagauuugugaauccagacacggguaggguccuguuugagugcaaacuucauaagucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5453 - RNA, 1623 nt, Artificial Sequence
  VP1__Norovirus__BAG70473
augaagauggcgucgaaugacgccaacccaucugauggguccgcagccaaccucgucccagaggucaacaaugagguuauggcucuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguacacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcaggcucucguaauuacacaaugaauuuggcuucucuaaauuggaacaauuacgacccaacagaagaaauuccagccccucuaggaacuccagauuucgugggaaagauccaaggugugcucacucaaaccacaaagggggauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguaguaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5454 - RNA, 1623 nt, Artificial Sequence
  VP1__Norovirus__BAG70476
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaacuuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaacccagacacggguaggguccuguuugagugcaaacuucauaaaucaggcuaugucacaguggcucacaccggccagcaugauuuggucaucccccccaauggcuauuuuagguuugauuccuggguuaaucaauucuauacacuugcccccaugggaaauggaacggggcguagacgugcuuuauaa

SEQ ID NO: 5455 - RNA, 1623 nt, Artificial Sequence
  VP1__Norovirus__BAG70482
augaagauggcgucgaaugacgccaacccaucugauggguccgcagccaaccucgucccagaggucaacaaugagguuauggcuuuggagcccguugucggugccgcuauugcagcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugacggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacucacauugcagguucucguaauuacacaaugaauuuggcuucucuaaauuggaauaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5456 - RNA, 1623 nt, Artificial Sequence
  VP1__Norovirus__BAG70485
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggagaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaguucaguacugauacagaaaaugauuuugaaacucaccaaaacacaaaauucaccccagucggugucauccaggaugguagcaccacccaccgaaaugaaccccaacaaugggugcucccaaguuauucagguagaaauguccaaaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuccauaaaucaggcuaugucacaguggcucacaccggccagcaugauuugguuaucccccccaaugguuauuuuagguuugauuccuggguuaaucaauucuacacacuugcccccaugggaaauggaacggggcguagacgugcuuuauaa

SEQ ID NO: 5457 - RNA, 1623 nt, Artificial Sequence
  VP1__Norovirus__BAG70488
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggagaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaguucaguacugauacagaaaaugauuuugaaacucaccaaaacacaaaauucaccccagucggugucauccaggaugguagcaccacccaccgaaaugaaccccaacaaugggugcucccaaguuauucagguagaaauguccaaaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuccauaaaucaggcuaugucacaguggcucacaccggccagcaugauuugguuaucccccccaaugguuauuuuagguuugauuccuggguuaaucaauucuacacacuugcccccaugggaaacggaacggggcguagacgugcuuuauaa

SEQ ID NO: 5458 - RNA, 1623 nt, Artificial Sequence
  VP1__Norovirus__BAG70491
augaagauggcgucgaaugacgccagcccaucugauggguccacagccaaccucgucccagaggucaacaaugagguuauggcuuuggagcccguuguuggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccacauaauaguagauguuaggcaauuggaaccuguguugauccccuuaccugauguuaggaacaauuucuaccauuacaaucaaucaaacgacuccaccauuaaauugauagcaaugcuguacacaccacuuagggcuaauaaugcuggggaugaugucuucacagucucuugucgaguccucacgaggccaucccccgauuuugauuucauauuucuggugccacccacaguugagucaagaaccaaaccauucaccgucccaauuuuaacuguugaggaaaugaccaauucaagauuucccauuccuuuggaaaaauuguucacgggucccagcagugccuuugucguccaaccacaaaauggcaggugcacgacugauggcgugcucuuaggcacuacccaacugucccccgucaacaucugcaccuucagaggagaugucacccacauuccagguacucguacuuacagaaugaauuuggcuucucaaaauuggaacaauuaugacccaacagaagaaaucccagccccucugggaacuccagauuucgugggaaagauccaaggcaugcucacccaaaccacaaagggagacggcucgacccgcggucacaaagcuacagugagcacugggaguguugacuucacuccaaagcugggcagcguucaguucgccacugacacagacaaugauuuugaaacuggccaaaacacaagguucaccccagucggugucauccaggaugguaguaguacccacagaaaugaaccccaacaauggguacucccagauuacucagguagaacugcucauaauguacaccuggccccugccguagcccccacuuuuccgggugagcaacuucuuuucuucagaucuacuaugcccggaugcaguggguaucccaauauggauuuggauugucuacucccccaggaaugggugcagcacuucuaccaagaggcagccccaucacaaucugacguggcuuuguugagauuugugaauccagacacagguaggguucuguuugagugcaagcuucauaaagcaggcuaugucacaguggcucacacuggccagcaugauuuggucaucccccccaauggcuacuuuagauuugauuccugggucaaccaguucuacacacuugcccccaugggaaauggagcggggcguagacgugcauuauaa

SEQ ID NO: 5459 - RNA, 1623 nt, Artificial Sequence
  VP1__Norovirus__BAG70494
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggaccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaauuucuaucacuauaaucagucaaaugauucuaccaucaaauugauagcaauguuguauacgccacuuagggcuaauaaugcuggggaagauguuuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucccgugacuacacaaugaauuuggcuucucuaaauuggaacaauuacgacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguacaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaaugugcaccuagccccugcuguagcccccacuuuuccgggugaacaacuucuuuucuucagguccacuaugcccggaugcagcggguaucccaacauggaucuggauugccuacucccccaggagugggugcagcacuucuaccaggaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucauuucuacacacuugcccccaugggaaauggaacggggcguagacgugcuuuauaa

SEQ ID NO: 5460 - RNA, 1623 nt, Artificial Sequence
  VP1__Norovirus__BAG70497
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaacugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5461 - RNA, 1623 nt, Artificial Sequence
  VP1__Norovirus__BAG70503
augaagauggcgucgaaugacgccaacccaucugauggguccgcagccaaccucgucccagaggucaacaaugagguuauggcucuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggagccuguguugauccccuuaccugauguuaggaauaacuucuaucacuauaaucagucaaaugauucuaccauuaaacugauagcaaugcuguacacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcaggcacucguaauuacacaaugaauuuggcuucucuaaauuggaacaauuacgacccaacagaagaaauuccagccccucuaggaacuccagauuucgugggaaagauccaaggugugcucacucaaaccacaaagggggauggcucgacccguggccauaaagcuacaguuuacacugggagugcccccuuuacuccaaagcugggcaguguucaauucaguacugauacagaaaaugauuuugaaacucaccaaaacacaaaguucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuccuuuucuucagguccacuaugcccggaugcagcggguaucccaacauggauuuggauugccuacucccccaggagugggugcagcacuucuaccaagaggcagcuccagcacaaucugauguggcucuaaugagauuugugaauccagacacggguagaguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5462 - RNA, 1623 nt, Artificial Sequence
  VP1__Norovirus__BAG70506
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaacugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguucagccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccacuuuuccgggugaacaacuucuuuucuucagguccaccaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5463 - RNA, 1623 nt, Artificial Sequence
  VP1__Norovirus__BAG70509
augaagauggcgucgaaugacgccaacccaucugauggguccgcagccaaccucgucccagaggucaacaaugagguuauggcucuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaccccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggagccuguguugauccccuuaccugauguuaggaauaacuucuaucacuauaaucagucaaaugauucuaccauuaaauugauagcaaugcuguacacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcaggcacucguaauuacacaaugaauuuggcuucucuaaauuggaacaauuacgacccaacagaagaaauuccagccccucuaggaacuccagauuucgugggaaagauccaaggugugcucacucaaaccacaaagggggauggcucgacccguggccauaaagcuacaguuuacacugggagugcccccuuuacuccaaagcugggcaguguucaauucaguacugauacagaaaaugauuuugaaacucaccaaaacacaaaguucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacaugaauuuggauugccuacucccccaggagugggugcagcacuucuaccaagaggcagccccagcacaaucugauguggcucugcuaagauuugugaauccagacacagguaggguucuguuugaguguaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5464 - RNA, 1623 nt, Artificial Sequence
  VP1__Norovirus__BAG70512
augaagauggcgucgaaugacgccaacccaucugauggguccgcagccaaccucgucccagaggucaacaaugagguuauggcucuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggagccuguguugauccccuuaccugauguuaggaauaacuucuaucacuauaaucagucaaaugauucuaccauuaaauugauagcaaugcuguacacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcaggcacucgcaauuacacaaugaauuuggcuucucuaaguuggaacaauuacgacccaacagaagaaauuccagccccucuaggaacuccagauuucgugggaaagauccaaggugugcucacucaaaccacaaagggggauggcucgacccguggccauaaagcuacaguuuacacuggaagugcccccuuuacuccaaagcugggcaguguucaauucaguacugauacagaaaaugauuuugaaacucaccaaaacacaaaguucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuaaugagauuugugaauccagacacggguagaguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5465 - RNA, 1623 nt, Artificial Sequence
  VP1__Norovirus__BAG70515
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggcuugagucccagccaagucacuauguucccccacauaauaguagauguuaggcaauuggaaccuguguugauccccuuaccugauguuaggaauaauuucuaucauuauaaucagucaaaugauucuaccauuaaauugauagcaaugcuguauacaccacuuagggcuaauaaugcuggggaagaugucuucacagucucuugucgaguccucacgaggccauccccugauuuugacuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaagguuugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcgcagacgugcuuuauaa

SEQ ID NO: 5466 - RNA, 1623 nt, Artificial Sequence
  VP1__Norovirus__BAG70518
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaauuuuuaucacuauaaucagucaaaugauucuaccauuaaauugauagcaaugcuguauacaccacuuagggcuaauaaugcuggggaagaugucuucacagucucuugucgaguccucacgaggccauccccugauuuugacuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaagguuugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccacuuuuccgggugaacaacuucuuuucuucagguccacuaugcccggaugcagcggguaucccaacauggauuuggacugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcgcagacgugcuuuauaa

SEQ ID NO: 5467 - RNA, 1623 nt, Artificial Sequence
  VP1__Norovirus__BAG70521
augaagauggcgucgagugacgccaacccaucugauggguccacagccaaccucgucccagaggucaacaaugagguuauggcuuuggagcccguuguuggugccgcuauugcggcaccuguagcgggccaacaaaacguaauugaccccuggauuagaaauaauuuuguacaagccccugguggagaguuuacaguauccccuagaaacgcuccaggugaaauacuauggagcgcgcccuugggcccugauuugaauccuuaccuuucccauuuggccagaauguacaauaguuaugcaggugguuuugaagugcagguaauccucgcggggaacgcguucaccgccggaaagaucauauuugcagcagucccaccaaauuucccaacugaaggcuugagccccagccaggucacuauguucccccauauaauaguagauguuaggcaacuggaaccuguguugaucccuuugcccgauguuaggaauaauuucuaucacuacaaucaaucaaaugaccccaccaucaaauugauagcaauguuguacacaccacuuagggcuaauaaugcuggggacgaugucuucacaguuucuugucggguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguuuacgggucccagcagugccuuuguuguucaaccacagaauggcaggugcacgacugauggcgugcucuuaggcaccacccaacugucuccugucaacaucugcaccuucagaggggaugucacccacauugcugguacucaagaauacacaaugaaucuggccucccaaaacuggaacaauuaugacccaacagaagaaaucccagccccucugggaacuccagauuucgugggcaagauccaaggcgugcucacccaaaccacaaggagggauggcucgacccgcggucacaaagccacagugagcacuggaaguguccacuucaccccaaagcugggcagaauucaauucuccacugauacaagcaaugauuuugaaacuggccaaaacacgagauucaccccagucgguguuguccaggauggugguaccacccaccaaaaugaaccccaacaauggguacucccaaauuauucagguagagauagucacaaugugcaccuagccccugccguggcccccucuuuuccgggugagcaacuucuuuucuucagguccacuaugcccggaugcagcggguaucccaacaugaauuuggauugucuacucccccaggagugggugcagcacuucuaccaagaggcagccccagcacaaucugauguggcucugcuaagauuugugaauccagacacagguaggguucuguuugaguguaagcuucauaaaucaggcuaugucacaguggcucacacuggccaacaugauuuaguuaucccccccaauggcuauuuuagauuugauuccugggucaaccaguucuacacacuugcccccaugggaaauggaacggggcguagacgugcauuauaa

SEQ ID NO: 5468 - RNA, 1623 nt, Artificial Sequence
  VP1__Norovirus__BAG70524
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaauuuuuaucacuauaaucagucaaaugauucuaccauuaaauugauagcaaugcuguauacaccacuuagggcuaauaaugcuggggaagaugucuucacagucucuugucgaguccucacgaggccauccccugauuuugacuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaagguuuacucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccacuuuuccgggugaacaacuuauuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcgcagacgugcuuuauaa

SEQ ID NO: 5469 - RNA, 1623 nt, Artificial Sequence
  VP1__Norovirus__BAG70527
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguuuaccgccggaaaaauuauauuugcagcagucccaccaaauuuuccaacugaaggcuugagucccagccaggucacuauguucccccacauaauaguagauguuagacaauuggaaccuguguugauccccuuaccugauguuaggaauaauuuuuaucacuauaaucagucaaaugauucuaccauuaaauugauagcaaugcuguauacaccacuuagggcuaauaaugcuggggaagaugucuucacagucucuugucgaguccucacgaggccauccccugauuuugacuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaguuaugacccaacagaagaaauuccagccccucuaggaacuccagauuucgugggaaagauccaagguuugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaacguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucauuccccccaauggcuauuuuagguuugauuccuggguuaaucaauucuacacacuugcccccaugggaaauggaacggggcgcagacgugcuuuauaa

SEQ ID NO: 5470 - RNA, 1623 nt, Artificial Sequence
  VP1__Norovirus__BAG70530
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuuuuaucacuauaaucagucaaaugauucuaccauuaaauugauagcaaugcuguauacaccacuuagggcuaauaaugcuggggaagaugucuucacagucucuugucgaguccucacgaggccauccccugauuuugacuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaagguuugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguggcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcgcagacgugcuuuauaa

SEQ ID NO: 5471 - RNA, 1623 nt, Artificial Sequence
  VP1__Norovirus__BAG70533
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaauuuuuaucacuauaaucagucaaaugauucuaccauuaaauugauagcaaugcuguauacaccacuuagggcuaauaaugcuggggaagaugucuucacagucucuugucgaguccucacgaggccauccccugauuuugacuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaagguuuacucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuacucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcgcagacgugcuuuauaa

SEQ ID NO: 5472 - RNA, 1623 nt, Artificial Sequence
  VP1__Norovirus__BAG70536
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaauuuuuaucacuauaaucagucaaaugauucuaccauuaaauugauagcaaugcuguauacaccacuuagggcuaauaaugcuggggaagaugucuucacagucucuugucgaguccucacgaggccauccccugauuuugacuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaagguuuacucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcgcagacgugcuuuauaa

SEQ ID NO: 5473 - RNA, 1623 nt, Artificial Sequence
  VP1__Norovirus__BAI70518
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuaggaauaauuuuguacaagccccugguggagaguucacaguauccccuagaaacgcuccaggugaaauacuauggagcgcgcccuuaggcccugaccugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaauuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuucauauuuuuggugccaccuacaguugagucaagaacuaaaccauuuacugucccaaucuuaacuguugaagaaaugaccaacucaagauuccccauuccuuuggagaaguuguucacgggucccagcagugccuuuguuguucaaccacaaaauggcagaugcacaacugauggcgugcucuuaggcaccacccagcugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuucacuccaaagcugggcaguguccaauucaguacugauacagaaaaugauuuugaaacccaccaaaacacaaaauucaccccagucggugucauccaggaugguggcaccacccaccgaaaugaaccucaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccuacuaccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaaugguuauuuuagguuugauuccuggguuaaucaauucuacacgcuugcccccaugggaaauggaacggggcguagacgugcuuuauaa

SEQ ID NO: 5474 - RNA, 1623 nt, Artificial Sequence
  VP1__Norovirus__BAJ13508
augaagauggcgucgaaugacgccaacccaucugauggguccacagccaaccucgucccagaggucaacaaugagguaauggcuuuggagcccguuguaggugccgcuauugcggcgccuguagcgggccaacaaaauguaauugaccccuggauuagaaauaauuuuguacaagccccugguggagaguuuacagugucccccagaaaugcuccaggugagauacuauggagugcgcccuugggcccugauuugaacccuuaccuuucucaucuggccagaauguauaaugguuaugcaggugguuuugaagugcagguaauccucgcggggaacgcguucaccgccggaaaaaucauauuugcagcaguuccaccuaacuuuccaacugaaggcuugagcccuagccagguuacuauguucccccauauaauaguagauguuaggcaauuggaaccuguguugauccccuuaccugauguuaggaauaacuucuaucacuacaaccagucaaaugacccuaccauuaaauugauagcaauguuguacacaccacuuagggccaauaaugcuggggaugaugucuucacagucucuugucgaguccucacgagaccauccccugacuuugacuucauauuucugguaccaccaacaguugaaucaagaaccaaaccauuuaccguuccaaucuuaacuguugaggaaaugaccaauucaagauuccccauuccuuuggaaagguuguacacgggucccagcagugcuuuuguuguccagccacaaaacggcaggugcacgacugauggcgugcucuuagguaccacccagcugucugcugucaacaucugcaccuuuagaggggaugucacucacauugcaggcucucgcaauuauacaaugaauuuggccucucaaaauuggaacaacuaugauccaacagaagaaaucccagccccccugggcaccccagauuucgugggaaagauccaaggcaugcucacccaaaccacaagaagugauggcucgacccgcggccacaaggccacagugcucacugggagugccgacuucgccccaaaauugggcagaguucaauucgccacugacacagacaacgauuucgaaucuggccaaaacacgaaauucaccccaguuggcgucauccaggauggcuccacuacccaccgaaaugaaccucaacaauggguacucccaaauuacucagguagaacuggucauaaugugcaucuagccccugcuguugcccccacuuacccgggugagcaacuccuuuucuucagguccacuaugcccggauguagcggguaccccaacauggaucuagauugcuugcucccccaggagugggugcagcacuucuaccaagaagcagcuccagcacaaucugauauggcucugcuaagauuugugaauccagacacagguaggguucucuuugagugcaagcuccauaaaucaggauaugucacaguggcucacacuggucagcaugauuugguuauuccccccaaugguuauuuuagauuugauuccuggguuaaucaauucuacacacucgcccccaugggaaaugggacggggcguagacgugcuguauaa

SEQ ID NO: 5475 - RNA, 1623 nt, Artificial Sequence
  VP1__Norovirus__BAJ13513
augaagauggcgucgagugacgccaacccaccugauggguccgcagccaaccucgucccagaggucaacaaugagguuauggcuuuggagcccguugucggugccgcuauugcggcgccuguggcgggccaacaaaauguaauugaccccuggauuagaaauaauuuugugcaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcaguuccaccaaauuuuccaacugagggcuugagucccagccaggucacuauguucccccacauaauaguagauguuaggcaauuggaaccuguguuaauccccuuaccugauguuaggaauaauuucuaucacuauaaccagucaaaugauucuaccauuaaauugauagcaaugcuguauacaccacuuagggcuaauaaugcuggggaagaugucuucacagucucuugucgaguccucacgaggccauccccugauuuugauuuuauauucuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugccacccacauugcagguucucguagcuacacaaugaauuuggcuucucuaaauuggaacaauuaugacccaacagaagaaauuccagccccucuaggaacuccagauuucgugggaaagauccaagguaugcucacucaaaccacaaagggagauggcucgacccguggccauaaagcuacaguuuacacugggagugcccccuuuacuccaaagcugggcaguguucaauucaguacugauacagaaaaugauuuucaaacucaccaaaacacaaaauucaccccagucggugucauccaggaugguagcaccacccaccgaaaugaaccccaacaaugggugcucccaaguuauucagguagagauguccauaauguacaccuagccccugcuguagcccccacuuucccgggugaacaacuucuuuucuucagguccacuaugcccggaugcagcggguaucccaacauggauuuggauugccuacucccccaggagugggugcagcacuucuaccaagaggcggcuccagcacaaucugauguggcucuauugagauuugugaauccagacacggguaggguccuguuugagugcaaacuucauaaaucaggcuaugucacaguggcucacaccggccagcaugauuuggucaucccccccaauggcuacuuuagguuugauuccuggguuaaucaauucuacacacuugcccccaugggaaauggaacggggcguagacgugcuuuauaa

SEQ ID NO: 5476 - RNA, 1623 nt, Artificial Sequence
  VP1__Norovirus__BAJ13520
augaagauggcgucgagugacgccaacccaucugauggguccgcagccaaccucgucccagaggucaacaaugagguuauggcuuuggagcccguugucggugccgcuauugcggcgccuguggcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcaguuccaccaaauuuuccaacugaaggcuugagucccagccaggucacuauguucccccacauaauaguagauguuaggcaauuggaaccuguguuaauccccuuaccugauguuaggaauaauuucuaucacuauaaccagucaaaugauucuaccauuaaauugauagcaaugcuguauacaccacuuagggcuaauaaugcuggggaagaugucuucacagucucuugucgaguccucacgaggccauccccugauuuugauuuuauauucuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaacuacacaaugaauuuggcuucucuaaauuggaacaauuaugacccaacagaagaaauuccagccccucuaggaacuccagauuucgugggaaagauccaagguaugcucacucaaaccacaaagggagauggcucgacccguggccauaaagcuacaguuuacacugggagugcccccuuuacuccaaagcugggcaauguucaauucaguacugauacagaaaaugauuuugaaacucaccaaaacacaaaauucaccccagucggugucauccaggaugguagcaccacccaccgaaaugaaccccaacaaugggugcucccaaguuauucagguagagauguccauaauguacaccuagccccugcuguagcccccacuuucccgggugaacaacuucuuuucuucagguccacuaugcccggaugcagcggguaucccaacauggauuuggauugccuacucccccaggagugggugcagcacuucuaccaagaggcggcuccagcacaaucugauguggcucuauugagauuugugaauccagacacggguaggguccuguuugagugcaaacuucauaaaucaggcuaugucacaguggcucacaccggccagcaugauuuggucaucccccccaauggcuacuuuagguuugauuccuggguuaaucaauucuacacacuugcccccaugggaaauggaacggggcguagacgugcuuuauaa

SEQ ID NO: 5477 - RNA, 1623 nt, Artificial Sequence
  VP1__Norovirus__BAJ13534
augaagauggcgucgaaugacgccaacccaucugauggguccgcagccaaccucgucccagaggucaacaaugagguuauggcuuuggagcccguugucggugccgccauugcggcgccuguagcgggccaacaaaauguaauugaccccuggauuagaaauaauuuuguacaagccccugguggggaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagaugucaggcaauuggaaccuguguugauccccuuaccugauguuaggaauaacuucuaucauuauaaucagucaagugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacggguccuagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagccccuacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauga

SEQ ID NO: 5478 - RNA, 1623 nt, Artificial Sequence
  VP1__Norovirus__BAJ13537
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaguccucgcggggaacgcguucaccgccggaaaaaucauauuugcagcagucccaccaaauuucccaacugaaggcuugagccccagccaggucacuauguucccccacauaauaguagaugucagacaauuggaaccuguguugauccccuuacccgauguuaggaauaauuucuaucacuacaaucaaucaaaugaccccaccaucaaauugauagcaauguuguauacaccacuuagggcuaauaaugcuggggacgaugucuucacaguuucuugucggguucucacgagaccaucccccgauuuugauuucauauuuuuagugccacccacaguugagucaagaacuaaaccauucucugucccuauuuuaacuguugaggagaugaccaauucaagauuccccauuccuuuggaaaagcuguucacgggucccagcagugccuuuguuguucaaccacaaaacggcaggugcacgacugauggcgugcuccuagguaccacccaacugucuccugucaacaucugcaccuucagaggggaugucacccauauuacagguagucguaacuacacaaugaauuuggcuacucaaaauuggaacaguuaugacccaacagaagaaaucccggccccucuaggaacuccagauuucguggggaagauucaaggugugcucacccaaaccacaagggcagauggcucgacccgcggccacaaagcuacaguguacacugggagcgccgauuuugcuccaaaacuggguagaguucaauuugccacugacacagacaaugauuuugaugcuaaccaaaacacaaaguucaccccagucggugucauccaggauggugauacugcccaccgaaaugaaccucaacaaugggugcucccaaguuacucaggcagaaauaaucauaaugugcaccuggcccccgcuguagcccccacuuuuccgggugagcaacuucucuucuucagauccacuaugcccggaugcagcggguaccccaacauggauuuggacugucugcucccccaggaaugggugcaguauuucuaucaagaggcagccccagcacaaucugauguggcucugcugagauuugugaauccagacacagguaggguuuuguuugaguguaagcuucauaaaucaggcuauguuacaguggcucacaccggccaacaugauuugguuaucccccccaaugguuauuuuagauuugauuccugggucaaccaguucuacacacuugcccccaugggaaauggaacggggcguagacgugcauuauaa

SEQ ID NO: 5479 - RNA, 1623 nt, Artificial Sequence
  VP1__Norovirus__BAJ13540
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaacccguguugauccccuuaccugauguuaggaauaacuucuaucauuauaaucagucaaaugauucuaccauuaaacugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaauuuuaacuguugaagaaaugaccaauucaagauuccccauuccuuuggaaaaguuguucacgggucccagcggugccuuuguuguucaaccacaaaauggcaggugcacgacugauggcgugcucuuaggcacuacccaacugucuccugucaacaucugcaccuucagaggggaugucacccacauuguagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggucauaaagcuacaguuuacacugggagugcccccuuuacuccaaagcugggcaguguucaauucaguacugauacagaaaaugauuuugaagcucaccaaaacacaaaauucaccccagucggugucauccaggaugguagcaccacccaucgaaaugaaccccaacaaugggugcucccaaguuauucagguagaaauguucaaaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcccacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5480 - RNA, 1623 nt, Artificial Sequence
  VP1__Norovirus__BAJ13543
augaagauggcgucgaaugacgccaacccaucugauggguccgcagccaaccucgucccagaggucaacaaugagguuauggcuuuggagccuguugucggugccgcuauugcagcgccuguagcgggccaacaaaauguaauugaccccuggauuagaaauaauuuuguacaagccccugguggagaguuuacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucgagaacuaaaccauuuacugucccaaucuuaacuguugaagagaugaccaauucaagauuccccaucccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaauaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaauacaaaauucaccccagucggugucauccaggaugguagcaccacccaccgaaaugaaccccaacaaugggugcucccaaguuauucagguagaaaugcccauaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaagcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5481 - RNA, 1623 nt, Artificial Sequence
  VP1__Norovirus__BAJ13549
augaagauggcgucgaaugacgccaacccaucugauggguccgcagccaaccucgucccagaggucaacaaugagguuauggcuuuggagcccguugucggugccgcuauugcagcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguuuaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagagaugaccaauucaagauuccccaucccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaauaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaaugcccauaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaagcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5482 - RNA, 1623 nt, Artificial Sequence
  VP1__Norovirus__BAJ13552
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaacccguguugauccccuuaccugauguuaggaauaacuucuaucauuauaaucagucaaaugauucuaccauuaaacugauagcaaugcuguauacaccacuuagggccaauaaugcuggggaagacgucuucacagucucuugucgaguccucacgaggccguccccugauuuugauuuuauauuuuuggugccacccacaguugagucaagaacuaaaccauuuacugucccaauuuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggucauaaagcuacaguuuacacugggagugcccccuuuacuccaaagcugggcaguguucaauucaguacugauacagaaaaugauuuugaagcucaccaaaacacaaaauucaccccagucggugucauccaggaugguagcaccacccaccgaaaugaaccccaacaaugggugcucccaaguuauucagguagaaauguucaaaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcccacaccggccaacaugauuuggucaucccccccaauggcuauuuuagguuugauuccuggguuaaucaauucuacacacuugcccccaugggaaauggaacggggcguagacgugcuuuauaa

SEQ ID NO: 5483 - RNA, 1623 nt, Artificial Sequence
  VP1__Norovirus__BAJ13555
augaagauggcgucgaaugaccccagcccaucugauggguccgcagccaaccucgucccagaggucaacaaugagguuauggcuuuggagcccguugucggugccgcuauugcggcgccuguagcgggccaacaaaauguaauugaccccuggauuagaaacaauuuuguacaagccccugguggagaguucacaguguccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacugucucuugucgaguucucacgaggccauccccugauuuugauuuuauauuuuuggugccaccuacaguugagucaagaacuaaaccauuuacugucccaaucuuaacuguugaagaaaugaccaacucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaacuacacaaugaauuuggccucucuaaauuggaacaauuaugacccaacagaagaaauuccagccccucuaggaacuccagauuucgugggaaagauccaaggugugcucacccaaaccacaaagggagauggcucgacccguggccauaaagcuacaguuuauacugggagugcccccuuuacuccaaagcugggcaguguucaauucaguacugauacagaaaaugauuuugaaacucaccaaaacacaaaauucaccccagucggcgucauccaggaugguggcaccacccaccgaaaugaaccccaacaaugggugcucccaaguuauucagguagagauguccagaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacgcuugcccccaugggaaauggaacggggcguagacgugcuuuauaa

SEQ ID NO: 5484 - RNA, 1623 nt, Artificial Sequence
  VP1__Norovirus__BAJ13558
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaacccguguugauccccuuaccugauguuaggaauaacuucuaucauuauaaucagucaaaugauucuaccauuaaauugauagcaaugcuguauacaccacuuagggccaauaaugcuggggaagacgucuucacagucucuugucgaguccucacgaggccguccccugauuuugauuuuauauuuuuggugccacccacaguugagucaagaacuaaaccauuuacugucccaauuuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggucauaaagcuacaguuuacacugggagugcccccuuuacuccaaagcugggcaguguucaauucaguacugauacagaaaaugauuuugaagcucaccaaaacacaaaauucaccccagucggugucauccaggaugguagcaccacccaccgaaaugaaccccaacaaugggugcucccaaguuauucagguagaaauguucaaaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcccacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5485 - RNA, 1623 nt, Artificial Sequence
  VP1__Norovirus__BAJ13561
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucacuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucccuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5486 - RNA, 1623 nt, Artificial Sequence
  VP1__Norovirus__BAJ13564
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaacuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacauuugcaccuucagaggggaugucacccacauugcagguucucguaauuacauaaugaauuuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5487 - RNA, 1623 nt, Artificial Sequence
  VP1__Norovirus__BAJ13567
augaagauggcgucgaaugacgccaacccaucugauggguccgcagccaaccucgucccagaggucaacaaugagguuauggcucuggagcccguugucggugccgcuauugcggcaccuguagcgggccaacaaaauguaauugaccccuggauuagaaauaauuuuguacaagccccugguggagaguucacaguaucuccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccauauaauaguagauguuaggcaauuggaaccuguguugauccccuuaccugauguuaggaauaacuucuaucacuauaaucagucaaaugauucuacuauuaaauugauagcaaugcuguacacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcagugccuuuguuguucaaccacaaaauggcagaugcacgacugauggcgugcucuuaggcaccacccaacugucuccugucaacaucugcaccuucagaggggacgucacccacauugcaggcucucgugauuacacaaugaauuuggcuucucuaaauuggaacaauuacgacccaacagaagaaauuccagccccucuaggaacuccggauuucgugggaaagauucaaggugugcucacucaaaccacaaagggggauggcucgacccguggccauaaagcuacaguuuacacugggagugcccccuuuacuccaaagcugggcaguguucgauucaguacugauacagaaaaugauuuugaaacucaccaaaacacaaaauucaccccagucggugucauccaggacgguaguaccacccaccgaaaugaaccccaacaaugggugcucccaaguuauucagguagagauguccauaauguacaccuagccccugcuguagcccccacuuuuccgggugaacaacuucuuuucuucagguccacuaugcccggaugcaguggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaccaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5488 - RNA, 1623 nt, Artificial Sequence
  VP1__Norovirus__BAJ13573
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaacccguguugauccccuuaccugauguuaggaauaacuucuaucauuauaaucagucaaaugauucuaccauuaaacugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaauuuuaacuguugaagaaaugaccaauucaagauuccccaucccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggucauaaagcuacaguuuacacugggagugcccccuuuacuccaaagcugggcaguguucaauucaguacugauacagaaaaugauuuugaagcucaccaaaacacaaaauucaccccagucggugucauccaggaugguagcaccacccaccgaaaugaaccccaacaaugggugcucccaaguuauucagguagaaauguucaaaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcccacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5489 - RNA, 1623 nt, Artificial Sequence
  VP1__Norovirus__BAJ13576
augaagauggcgucgaaugacgccaacccaucugauggguccgcggccaaccucgucccagaggucaacaaugagguuauggcuuuggagcccguugucggugccgcuauugcggcgccuguagcgggccaacaaaauguaauugaccccuggauuagaaauaacuuuguacaagccccugguggagaguucacaguauccccuagaaacgcuccaggugaaauaccauggagcgaacccuuaggcccugaucugaaucccuacuuaucucauuuggccagaauguauaaugguuaugcaggugguuuugaagugcaggugauccucgcggggaacgcguucaccgccggaaagauuauauuugcagcagucccaccaaauuuuccaacugaaggcuugagucccagccaggucacuauguucccccacauaauaguagauguuaggcaauuggaaccuguguugauccccuugccugauguuaggaauaacuucuaccacuauaaucagucaaaugauucuaccauuaaauugauagcaaugcuguauacaccacuuagggccaauaaugcuggggaagaugucuucacggucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucugggaacuccagauuucgugggaaagauccaaggugugcucacucaaaccacaaagggagauggcucgacccggggccauaaagcuacaguuuacacugggagugccgacuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguccauaaugugcaccuagccccugcuguggcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccaacaugaucuggucaucccccccaauggcuauuuuagguuugauuccuggguuaaucaauucuacacacuugcccccaugggaaauggaacggggcguagacgugcuuuauaa

SEQ ID NO: 5490 - RNA, 1623 nt, Artificial Sequence
  VP1__Norovirus__BAJ13579
augaagauggcgucgaaugacgccaacccaucugauggguccgcggccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuacuuaucucauuuggccagaauguauaaugguuaugcaggugguuuugaagugcaggugauccucgcggggaacgcguucaccgccggaaagauuauauuugcagcagucccaccaaauuuuccaacugaaggcuugagucccagccaggucacuauguucccccacauaauaguagauguuaggcaauuggaaccuguguugauccccuugccugauguuaggaauaacuucuaccacuauaaucagucaaaugauucuaccauuaaauugauagcaaugcuguauacaccacuuagggccaauaaugcuggggaagaugucuucacggucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucugggaacuccagauuucgugggaaagauccaaggugugcucacucaaaccacaaagggagauggcucgacccggggccauaaagcuacaguuuacacugggagugccgacuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguccauaaugugcaccuagccccugcuguggcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccaacaugaucuggucaucccccccaauggcuauuuuagguuugauuccuggguuaaucaauucuacacacuugcccccaugggaaauggaacggggcguagacgugcuuuauaa

SEQ ID NO: 5491 - RNA, 1623 nt, Artificial Sequence
  VP1__Norovirus__BAJ13582
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaacaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuagguaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccgcggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuccuuuucuucagguccacuaugcccggaugcagcggguaucccaacauggauuuggauugccuacucccucaggagugggugcagcacuucuaccaagaggcagcuccagcacaaucugauguggcucuauugagauuugugaauccagacacggguaggguccuguuugagugcaaacuucauaagucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5492 - RNA, 1623 nt, Artificial Sequence
  VP1__Norovirus__BAJ13585
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaauguuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaaccccagauuucgugggaaagauucaaggagugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuucagguccacuaugcccggaugcagcggguaucccaacauggauuuggauugccugcucccccaggagugggugcagcacuucuaccaagaggcagcuccagcacaaucugauguggcucuauugagauuugugaauccagacacggguaggguccuguuugagugcaagcuucacaaaucaggcuaugucacaguggcucacaccggccagcaugauuuggucaucccccccaaugguuauuuuagguuugauuccuggguuaaucaguucuacacacuugcccccaugggaaauggaacggggcguagacgugcuuuauaa

SEQ ID NO: 5493 - RNA, 1623 nt, Artificial Sequence
  VP1__Norovirus__BAJ13591
augaagauggcgucgaaugacgccaacccaucugauggguccgcagccaaccucgucccagagguuaacaaugagguuauggcuuuggagcccguugucggugccgcuauugcggcgccuguagcgggccaacaaaauguaauugaccccuggauuagaaauaauuuuguacaagccccugguggagaguuuacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucgcaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuuuauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5494 - RNA, 1623 nt, Artificial Sequence
  VP1__Norovirus__BAJ13594
augaagauggcgucgagugacgccaacccaucugauggguccgcagccaaccucgucccagaggucaacaaugagguuauggcuuuggagcccguugucggugccgcuauugcggcgccuguggcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcaguuccaccaaauuuuccaacugaaggcuugagucccagccaggucacuauguucccccacauaauaguagauguuaggcaauuggaaccuguguuaauucccuuaccugauguuaggaauaauuucuaucacuauaaccagucaaaugauucuaccauuaaauugauagcaaugcuguauacaccacuuagggcuaauaaugcuggggaagaugucuucacagucucuugucgaguccucacgaggccauccccugauuuugauuuuauauucuuggugccaccuacaguugagucgagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaacuacacaaugaauuuggcuucucuaaauuggaacaauuaugacccaacagaagaaauuccagccccucuaggaacuccagauuucgugggaaagauccaagguaugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccggucggugucauccaggaugguagcaccacccaccgaaaugaaccccaacaaugggugcucccaaguuauucagguagagauguccauaauguacaccuagccccugcuguagcccccacuuucccgggugaacaacuucuuuucuucagguccacuaugcccggaugcaguggguaucccaacauggauuuggauugccuacucccccaggagugggugcagcacuucuaccaagaggcggcuccagcacaaucugauguggcucuauugagauuugugaauccagacacggguaggguccuguuugagugcaaacuucauaaaucaggcuaugucacaguggcucacaccggccagcaugauuuggucaucccccccaauggcuacuuuagguuugauuccuggguuaaucaauucuacacacuugcccccaugggaaauggaacggggcguagacgugcuuuauaa

SEQ ID NO: 5495 - RNA, 1623 nt, Artificial Sequence
  VP1__Norovirus__BAJ13597
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaacccguguugauccccuuaccugauguuaggaauaacuucuaucauuauaaucagucaaaugauucuaccauuaaacugauagcaaugcuguauacaccacuuagggccaauaaugcuggggaagacgucuucacagucucuugucgaguccucacgaggccguccccugauuuugauuuuauauuuuuggugccacccacaguugagucaagaacuaaaccauuuacugucccaauuuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggucauaaagcuacaguuuacacugggagugcccccuuuacuccaaagcugggcaguguucaauucaguacugauacagaaaaugauuuugaagcucaccaaaacacaaaauucaccccagucggugucauccaggaugguagcaccacccaccgaaaugaaccccaacaaugggugcucccaaguuauucagguagaaauguucaaaauguacaccuagccccugcuguagcccccaccuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcccacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5496 - RNA, 1623 nt, Artificial Sequence
  VP1__Norovirus__BAJ13603
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaauguuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacugucgaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaaccccagauuucgugggaaagauccaaggagugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccugcucccccaggagugggugcagcacuucuaccaagaggcagcuccagcacaaucugauguggcucuauugagauuugugaauccagacacggguaggguccuguuugagugcaagcuucacaaaucaggcuaugucacaguggcucacaccggccagcaugauuuggucauccccccuaaugguuauuuuagguuugauuccuggguuaaucaguucuacacacuugcccccaugggaaauggaacggggcguagacgugcuuuauaa

SEQ ID NO: 5497 - RNA, 1623 nt, Artificial Sequence
  VP1__Norovirus__BAJ13606
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguuuacaguauccccuagaaacgcuccaggugaaauauuauggagcgcgcccuuaggcccugaccugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugagccccagccaggucacuauguucccccacauaauaguggauguuaggcaauuggaaccuguguugauccccuuaccugauguuaggaauaauuucuaucacuauaaucagucaaaugauucuaccauuaaauugauagcaaugcuguauacaccacuuagggcuaauaaugcuggggaagaugucuucacagucucuugucgaguucucacgagaccauccccugauuuugauuucauauuuuuggugccaccuacaguugagucaagaacuaaaccauuuacugucccaaucuugacuguugaggaaaugaccaauucaagauuccccauuccuuuggaaaaguuguucacgggucccagcagugccuuuguuguucaaccacaaaauggcagaugcacgacugauggcgugcucuuaggcaccacccaacugucuccugucaacaucugcaccuucagaggggaugucacccacauugcagguucucgugauuacacaaugaauuuggcuucucuaaauuggaacaauuaugacccaacagaagaaauuccagccccucuaggaacuccagauuucgugggaaagauccaaggugugcucacccaaaccacaaagggagauggcucgacccguggccauaaagcuacaguuuacacugggagugcccccuuuacuccaaagcugggcaguguucaauucaguacugauacaggagaugauuuucaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaccccaacauggauuuggauugccuacucccccaggagugggugcagcacuucuaccaagaggcagcuccagcacaaucugauguggcucuauugagauuugugaauccagacacggguaggguccuguuugagugcaaacuucauaaagcaggcuaugucacaguggcucacaccggccagcacgauuuggucaucccccccaaugguuacuuuagguuugauuccuggguuaaucaauucuacacacuugcccccaugggaaauggaacggggcguagacgugcuuuauaa

SEQ ID NO: 5498 - RNA, 1623 nt, Artificial Sequence
  VP1__Norovirus__BAJ13609
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaacuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacauuugcaccuucagaggggaugucacccacauugcagguucucguaauuacauaaugaauuuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuuacccccaugggaaauggaacggggcguagacgugcuuuauaa

SEQ ID NO: 5499 - RNA, 1623 nt, Artificial Sequence
  VP1__Norovirus__BAJ13612
augaagauggcgucgaaugacgccaacccaucugauggguccgcagccaaccucgucccagaggucagcaaugagguuauggcuuuggagcccguugucggugccgcuauugcggcgccuguagcgggccaacaaaaugugauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggccugagucccagccaggucaccauguucccccacauaauaguagauguuaggcaauuggaaccuguguugauccccuuaccugauguuaggaauaauuucuaucacuauaaucagucaaaugauucuaccauuaaauugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaauaauuaugacccaacagaagaaauuccagccccucugggaacuccagauuucgugggaaagauccaaggugugcucacucaaaccacaaagggagauggcucgacccguggccauaaagcuacaguuuacacugggagugcccccuuuacuccaaagcuggguaguguucaauucaguacugauacagaaaaugauuuugaaacucaccaaaacacaaaauucaccccagucggugucauccaggaugguggcaccacccaccgaaaugaaccccaacaaugggugcucccaaguuacucagguagagauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcccuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacucgcccccaugggaaauggaacggggcguagacgugcuuuauaa

SEQ ID NO: 5500 - RNA, 1623 nt, Artificial Sequence
  VP1__Norovirus__BAJ13615
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauucccuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacacaccaaaacacaaaauucaccccagucggugucauccaggaugguggcaccacccaccgaaaugaaccccaacaaugggugcucccaaguuauucagguagaaauguccauaauguacaccuagccccugcuguagccccuacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5501 - RNA, 1623 nt, Artificial Sequence
  VP1__Norovirus__BAJ13618
augaagauggcgucgaaugacgccaacccaucugauggguccgcagccaaccucgucccagaggucaacaaugagguuauggcuuuggagcccguugucggugccgcuauugcggcgccuguagcgggccaacaaaaugugauugaccccuggauuagaaauaauuuuguacaagccccugguggagaguucacaguauccccuagaaacgcuccaggugaaauacuauggagcgcgcccuuaggcccugaucugaaucccuaccuaucccauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaccacuauaaucagucaaaugauucuaccauuaaauugauagcaaugcuguauacaccacuuagggcuaauaaugcuggggaggaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguuuacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaacuuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccaaaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaagcuucauaaaucaggcuaugucacaguggcucacaccggccagcaugauuuggucaucccccccaaugguuauuuuagguuugauuccuggguuaaucaauucuacacacuugcccccaugggaaauggagcggggcguagacgugcuuuauaa

SEQ ID NO: 5502 - RNA, 1623 nt, Artificial Sequence
  VP1__Norovirus__BAJ13621
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuagaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaacuggaacaauuaugacccaacagaagaaauuccagccccucuaggaacuccagauuucgugggaaagauccaaggugugcucacucaaaccacgaagggagauggcucgacccguggccauaaagcuacaguuuacacugggagugcccccuucacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcucacaccggccagcaugauuuggucaucccccccaauggcuauuuuagguuugauuccugggucaaucaauucuacacacuugcccccaugggaaauggaacggggcguagacgugcuuuauaa

SEQ ID NO: 5503 - RNA, 1623 nt, Artificial Sequence
  VP1__Norovirus__BAJ13624
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagucaggucacuauguucccccacauaauaguggauguuaggcaauuggaaccuguguugauccccuuaccugauguuaggaauaacuucuaucauuauaaucagucaaaugauucuaccauuaaauugauagcaaugcuguauacaccgcuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuugcuguucaaccacaaaauggcagaugcacgacugauggcgugcucuuaggcaccacccaacugucuccugucaacaucugcaccuucagaggggaugucacccacauugcagguucucguaauuacacaaugaacuuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacaguuuacacugggagugcccccuuuacuccaaagcuggguaguguucaauucaguacugauacagagaaugauuuugaaacucaccaaaacacaaaauucaccccagucggugucauccaggaugguagcaccacccaucgaaaugaaccccaacaaugggugcucccaaguuauucagguagaaaugucccuaacguacaccuagccccugcuguagcccccacuuucccgggugaacaacuucuuuucuuuaggucuacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucauaccggccagcaugauuuggucaucccccccaaugguuauuucagguuugauuccuggguuaaucaauucuacacacuugcccccaugggaaauggaacggggcguagacgugcuuuauaa

SEQ ID NO: 5504 - RNA, 1623 nt, Artificial Sequence
  VP1__Norovirus__BAJ13627
augaagauggcgucgaaugacgccaacccaucugauggguccgcagccaaccucgucccagaggucaacaaugagguuauggcuuuggagcccguugucggugcugcuauugcggcgccuguagcgggccaacaaaauguaauugaccccuggauuagaaauaauuuuguacaagcccccgguggagaguucacaguauccccuaggaacgcuccaggugaaauacuauggagcgcgccccuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggagcccguguugauccccuuaccugauguuaggaauaacuucuaucauuauaaucagucaaaugacucuaccauuaaauugauagcaaugcuguauacaccacuuagggcuaauaaugcuggggaagaugucuucacagucucuugucgaguccucacgaggccguccccugauuuugauuuuauauuuuuggugccaccuacaguugagucaagaacuaaaccauuuacugucccaaucuuaacuguugaagaaaugaccaauucaagauucccuauuccuuuggaaaaguuguucacgggucccagcggugccuuuguuguucaaccacaaaauggcagaugcacgacugauggcgugcucuuagguaccacccaacugucuccugucaacaucugcaccuucagaggggaugucacccacauugcagguucucgugauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggaguacccccuuuacuccaaagcugggcaguguucaauucagcacugauacagaaaaugauuuugaaacucaccaaaacacaaaauuuaccccagucggugucauccaggaugguagcaccacccaccgaaaugaaccccaacaaugggugcucccaaguuauucagguagaaauguccaaaauguacaccuagccccugcuguagcccccacuuuuccgggugaacaacuucuuuucuucagguccacuaugcccggaugcagcggguauccuaacauggauuuggauugccuacucccccaggagugggugcagcacuucuaccaagaggcagcuccagcacaaucugauguggcucuacugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5505 - RNA, 1623 nt, Artificial Sequence
  VP1__Norovirus__BAJ13630
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguuuacaguauccccuagaaacgcuccaggugaaauauuauggagcgcgcccuuaggcccugaccugaaucccuaccuaucucauuuggccagaauguacaaugguuaugcaggugguuuugaagugcaggugauccucgcggggaacgcguucaccgccgggaaaauuauauuugcagcagucccaccaaauuuuccaacugaaggcuugagccccagccaggucacuauguucccccacauaauaguggauguuaggcaauuggaaccuguguugauccccuuaccugauguuaggaauaauuucuaucacuauaaucagucaaaugauucuaccauuaaauugauagcaaugcuguauacaccacuuagggcuaauaaugcuggggaagaugucuucacagucucuugucgaguucucacgagaccauccccugauuuugauuucauauuuuuggugccaccuacaguugagucaagaacuaaaccauuuacugucccaaucuugacuguugaggaaaugaccaauucaagauuccccauuccuuuggaaaaguuguucacgggucccagcagugccuuuguuguucaaccacaaaauggcagaugcacgacugauggcgugcucuuaggcaccacccaacugucuccugucaacaucugcacuuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacccaaaccacaaagggagauggcucgacccguggccacaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaagcaggcuaugucacaguggcucacaccggccagcacgauuuggucaucccccccaaugguuacuuuagguuugauuccuggguuaaucaauucuacacacuugcccccaugggaaauggaacggggcguagacgugcuuuauaa

SEQ ID NO: 5506 - RNA, 1623 nt, Artificial Sequence
  VP1__Norovirus__BAJ13633
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaauuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauucccuuggaaaaauuguucacgggucccagcagugccuuuguuguucaaccacaaaauggcagaugcacgacugauggcgugcucuugggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaagauucaccccagucggugucauccaggaugguggcaccacccaccgaaaugaaccccaacagugggugcucccaaguuacucagguagaaaugucccuaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauuuuacacacuugcccccaugggaaauggaacggggcguagacguguuucauaa

SEQ ID NO: 5507 - RNA, 1623 nt, Artificial Sequence
  VP1__Norovirus__BAJ13636
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugagucccagccaggucacuauguucccccacauaauaguagauguuaggcaauuggaacccguguugauccccuuaccugauguuaggaauaacuucuaucauuauaaucagucaaaugauucuaccauuaaacugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaauuuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucagaccacgaagggagauggcucgacccguggucauaaagcuacaguuuacacugggagugcccccuucacuccaaagcugggcaguguucaauucaguacugauacagaaaaugauuuugaagcucaccaaaacacaaaauucaccccagucggugucauccaggaugguagcaccacccaccgaaaugaaccccaacaaugggugcucccaaguuauucagguagaaauguucaaaauguacaccuagccccugcuguagcccccacuuuuccgggugaacaacuacuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcccacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5508 - RNA, 1623 nt, Artificial Sequence
  VP1__Norovirus__BAJ13639
augaagauggcgucgaaugacgccaacccaucugauggguccgcagccaaccucguccaggaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaacuuuccaacugaaggcuugagucccagccaggucacuauguucccucacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacauuugcaccuucagaggggaugucacccacauugcagguucucguaauuacauaaugaauuuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguggaaauguccauaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5509 - RNA, 1623 nt, Artificial Sequence
  VP1__Norovirus__BAJ13642
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccauauaauaguagauguuaggcaauuggaacccguguugauccccuuacccgauguuaggaauaacuucuaucauuauaaucagucaaaugauucuaccauuaaacugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaauuuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggucauaaagcuacaguuuacacugggagugcccccuuuacuccaaagcugggcaguguucaauucaguacugacacagaaaaugauuuugaagcucaccaaaacacaaaauucaccccagucggugucauccaggaugguagcaccacccaccgaaaugaaccccaacaaugggugcucccaaguuauucagguagaaauguucaaaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcccacaccggccagcaugauuuggucaucccccccaauggcuauuucagguuugauuccuggguuaaucaauucuacacacuugcccccaugggaaauggaacggggcguagacgugcuuuauaa

SEQ ID NO: 5510 - RNA, 1623 nt, Artificial Sequence
  VP1__Norovirus__BAJ13648
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuaggaauaauuuuguacaagccccugguggagaguucacaguauccccuagaaacgcuccaggugaaauacuauggagcgcgcccuuaggccccgaucugaaucccuaccuaucucauuuggccagaauguauaaugguuaugcaggugguuuugaagugcaggugauccucgcggggaacgcguucaccgccggaaaaauuauauuugcagcaguuccaccaaacuuuccaacugaaggcuugagccccagucaggucacuauguucccccacauaauaguagauguuaggcaacuggaaccuguauugauccccuuaccugauguuaggaauaacuucuaucauuauaaucagucaaaugauucuaccauuaaauugauagcaaugcuguauacaccacuuagggcuaauaaugcuggggaagaugucuucacagucucuugccgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuugucguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucugggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagagauguccauaauguacaccuggccccugcuguagcccccacuuuuccgggugaacaacuucuuuucuucagguccacuaugcccggaugcaguggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5511 - RNA, 1623 nt, Artificial Sequence
  VP1__Norovirus__BAJ13651
augaagauggcgucgaaugacgccaacccaucugauggguccgcagccaaccucgucccagaggucaacaaugagguuauggcuuuggagcccguugucggugccgcuauugcggcgccuguagcgggucaacaaaauguaauugaccccuggauuagaaauaauuuuguacaagcccccgguggagaguucacaguguccccuagaaacgcucccagugaaauacuauggagcgcgcccuuaggcccugaccugaaccccuaccuaucucauuuggccagaauguauaaugguuaugcaggugguuuugaagugcaggugauccucgcggggaacgcguucaccgccggaaaaaucauauuugcagcagucccaccaaauuuuccaacugaaggcuugagucccagccaggucacuauguucccccacauaauaguggauguuaggcaauuggagccuguguugauccccuuaccugauguuaggaauaacuucuaucacuauaaucagucaaaugauucuaccauuaaauugauagcaauguuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucuauaaauuggaacaauuaugacccaacagaagaaauuccagccccucuaggaaccccagauuucgugggaaagauucaaggagugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccaaaaugaaccccaacaaugggugcucccagguuauucagguagaaaugucccuaauguacacuuagccccugcuguagcucccacuuuuccgggugaacaacuucuuuucuucagguccacuaugcccggaugcagcggguaucccaacauggauuuggauugccugcucccccaggagugggugcagcacuucuaccaagaggcagcuccagcacaaucugauguggcucuauugagauuugugaauccagacacggguaggguccuguuugagugcaagcuucacaaaucaggcuaugucacaguggcucacaccggccagcaugauuuggucaucccccccaaugguuauuuuagguuugauuccuggguuaaucaguucuacacacuugcccccaugggaaauggaacggggcguagacgugcuuuauaa

SEQ ID NO: 5512 - RNA, 1623 nt, Artificial Sequence
  VP1__Norovirus__BAJ13654
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuaggaauaauuuuguacaagccccugguggagaguucacaguauccccuagaaacgcuccaggugaaauacuauggagcgcgcccuuaggccccgaucugaaucccuaccuaucucauuuggccagaauguauaaugguuaugcaggugguuuugaagugcaggugauccucgcggggaacgcguucaccgccggaaaaauuauauuugcagcaguuccaccaaacuuuccaacugaaggcuugagccccagucaggucacuauguucccccacauaauaguagauguuaggcaacuggaaccuguauugauccccuuaccugauguuaggaauaacuucuaucauuauaaucagucaaaugauucuaccauuaaauugauagcaaugcuguauacaccacuuagggcuaauaaugcuggggaagaugucuucacagucucuugccgaguccucacgaggccauccccugauuuugauuuuauauuuuuggugccaccuacaauugagucaagaacuaaaccauuuacugucccaaucuuaacuguugaagaaaugaccaauucaagauuccccauuccuuuggaaaaguuguucacgggucccagcggugccuuugucguucaaccacaaaauggcagaugcacgacugauggcgugcucuuaggcaccacccaacugucuccugucaacaucugcaccuucagaggggaugucacccacauugcagguucucgugauuacacaaugaauuuggcuucucuaaauuggaacaauuaugacccaacagaagaaauuccagccccucugggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagagguguccauaauguacaccuggccccugcuguagcccccacuuuuccgggugaacaacuucuuuucuucagguccacuaugcccgggugcaguggguaucccaacauggauuuggauugccuacucccccaggagugggugcagcacuucuaccaagaggcagcuccagcacaaucugauguggcucuauugagauuugugaauccagacacggguaggguccuguucgagugcaaacuucauaaaucaggcuaugucacaguggcucacaccggccagcaugauuuggucaucccccccaauggcuacuuuagguuugauuccuggguuaaucaauucuacacacuugcccccaugggaaauggaacggggcguagacgugcuuuauaa

SEQ ID NO: 5513 - RNA, 1623 nt, Artificial Sequence
  VP1__Norovirus__BAJ13657
augaagauggcgucgaaugacgccagcccaucugauggguccgcagccaaccucgucccagaggucaacaaugagguuauggcuuuggagcccguugucggugccgcuauugcggcgccuguagcgggccaacaaaauguaauugaccccuggauuagaaacaauuuuguacaagccccugguggagaguucacaguguccccuagaaacgcuccaggugaaauacuauggagcgcauccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacugucucuugucgaguucucacgaggccauccccugauuuugauuuuauauuuuuggugccaccuacaguugagucaagaacuaaaccauuuacugucccaaucuuaacuguugaagaaaugaccaacucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaacuacacaaugaauuuggccucucuaaauuggaacaauuaugacccaacagaagaaauuccagccccucuaggaacuccagauuucgugggaaagauccaaggugugcucacccaaaccacaaagggagauggcucgacccguggccauaaagcuacaguuuauacugggagugcccccuuuacuccaaagcugggcaguguucaauucaguacugauacagaaaaugauuuugaaacucaccaaaacacaaaauucaccccagucggcgucauccaggaugguggcaccacccaccgaaaugaaccccaacaaugggugcucccaaguuauucagguagaaauguccagaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacgcuugcccccaugggaaauggaacggggcguagacgugcuuuauaa

SEQ ID NO: 5514 - RNA, 1623 nt, Artificial Sequence
  VP1__Norovirus__BAJ13660
augaagauggcgucgaaugacgccaacccaucugauggguccgcagccaaccucgucccagaggucaacaaugagguuauggcucuggagcccguugucggugccgcuauugcggcaccuguagcgggccaacaaaauguaauugaccccuggauuagaaauaauuuuguucaagccccugguggagaguucacaguaucuccuagaaacgcuccaggugaaauaccauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguacacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcagugccuuuguuguucaaccacaaaauggcagaugcacgacugauggcgugcucuuaggcaccacccaacugucuccugucaacaucugcacuuucagaggggaugucacccacauugcaggcucucgugauuacacaaugaauuuggcuucucuaaauuggaacaauuacgacccaacagaagaaauuccagccccucuaggaacuccagauuucgugggaaagauucaaggugugcucacucaaaccacaaagggggauggcucgacccguggccauaaagcuacaguuuacacugggagugcccccuuuacuccaaagcugggcaguguucgauucaguacugauacagaaaaugauuuugaaacucaccaaaacacaaaauucaccccagucggugucauccaggacgguaguaccacccaccgaaaugaaccccaacaaugggugcucccaaguuauucagguagagauguccauaauguacaccuagccccugcuguagcccccacuuuuccgggugagcaacuucuuuucuucagguccacuaugcccggaugcaguggguaucccaacauggauuuggacugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuucagguuugacuccuggguuaaucaauucuacacacuugcccccaugggaaauggaacggggcguagacgugcuuuauaa

SEQ ID NO: 5515 - RNA, 1623 nt, Artificial Sequence
  VP1__Norovirus__BAJ13663
augaagauggcgucgaaugacgccaacccaucugauggguccgcagccaaccucgucccagaggucaacaaugaggguauggcuuuggagcccguugucggugccgcuauugcggcgccuguagcgggccaaacaaauguaauugaccccuggauuagaaauaauuuuguacaagccccugguggagaguucacaguauccccuagaaacgcucccagugaaauacuauggagcgcguccuuagguccugaucugaaucccuaccuaucucauuuggccagaauguauaaugguuaugcaggugguuuugaagugcaggugauccucgcggggaacgcguucaccgccgggaaaauuauauuugcagcaguuccaccaaauuuuccaacugaaggcuugagucccagccaggucacuauguucccccacauaauaguagauguuaggcaauuggaaccuguguugauccccuuaccugauguuaggaauaacuucuaucacuacaaucagucaaaugauucuaccauuaaauugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucccuaaauuggaacaauuaugacccaacagaagaaauuccagccccucuaggaacuccagauuucgugggaaagauccaaggugugcucacucaaaccacaaagggaaauggcucgacccguggccauaaagccacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaguguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcucacaccggccagcaugauuuggucaucccccccaauggcuauuuuagguuugauuccugggucaaucaauucuacacacuugcccccaugggaaauggaacggggcguagacgugcuuuauaa

SEQ ID NO: 5516 - RNA, 1623 nt, Artificial Sequence
  VP1__Norovirus__BAJ13666
augaagauggcgucgaaugacgccaacccaucugauggguccgcagccaaccucgucccagaggucaacaaugagguuauggcuuuggagcccguugucggugccgcuauugcagcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcaguuccaccaaauuuuccaacugaaggcuuaagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagagaugaccaauucaagauuccccaucccuuuggaaaaauuguucacgggucccagcagugccuuuguuguucaaccacaaaauggcagaugcacgacugauggcgugcucuuaggcaccacccaacugucuccugucaacaucugcaccuucagaggggauaucacccacauugcagguucucguaauuacacaaugaauuuggcuucucuaaauuggaauaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaaugcccauaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5517 - RNA, 1623 nt, Artificial Sequence
  VP1__Norovirus__BAJ13669
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuugugcaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauucgcagcagucccaccaaacuuuccaacugaaggcuugagucccagccaggucacuauguucccccacauaauaguagauguuaggcaauuagaaccuguguugaucccuuuaccugauguuaggaauaacuucuaucacuacaaucagucaaaugauucuaccauuaaauugauagcaaugcuguauacaccacuuagggccaauaaugcuggggaugaugucuucacagucucuugucgaguccucacgagaccauccccugauuuugauuuuauauuuuuggugccaccuacaguugagucaagaaccaagccauucacugucccaaucuuaacuguugaagaaaugaccaauucaagauuccccauuccuuuggaaaaacuguucacgggucccagcagugccuuuguuguucaaccacaaaauggcagaugcacuacugauggcgugcucuuaggcaccacccaacugucuccugucaacaucugcaccuucagaggagaugucacccacauugcggguucccgcaauuacacaaugaauuuggccucucuaaauuggaacaauuaugacccaacagaagaaauuccagccccccugggaacuccagauuuugugggaaagauccaaggugugcucacucaaaccacaaagggagauggcucgacccggggccauaaagcuacaguuuacacugggagugccgacuuuacuccaaagcugggcagcguucaauuugguacugauacagaaaaugacuuugaaacucaccaaaacacaaaauucaccccagucggugucauccaggaugguagcaccacccaccgaaaugaaccccaacaaugggugcucccaagcuauucagguagaaauguccauaauguacaccuagccccugcuguagcucccaauuucccgggugaacaacuucuuuucuucagguccacuaugcccggaugcagcggguaucccaacauggauuuggauugccugcucccccaggagugggugcagcacuucuaccaagaggcagcuccagcacaaucugauguggcucuauugagauuugugaauccagacacggguaggguccuguuugagugcaaacuucacaaaucaggcuaugucacaguggcucacaccggccaacaugauuuggucaucccccccaauggcuauuuuagguuugauuccuggguuaaccaauucuacacacuugcccccaugggaaauggaacggggcguagacgugcuuuauaa

SEQ ID NO: 5518 - RNA, 1623 nt, Artificial Sequence
  VP1__Norovirus__BAJ13672
augaagauggcgucgaaugacgccaaccgaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccgacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuuuagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaagugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucacaaaucaggcuaugucacaguggcucacaccggccagcaugauuuggucaucccccccaaugguuauuuuagguuugauuccugggucaaucaauucuauacacuugcccccaugggaaauggaacggggcguagacgugcuuuauaa

SEQ ID NO: 5519 - RNA, 1623 nt, Artificial Sequence
  VP1__Norovirus__BAJ13675
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcacccuuaggcccugaucugaaucccuaccuaucucauuuggccagaauguauaauaguuaugcaggugguuuugaagugcaggugauccucgcggggaacgcguucaccgccgguaaaaucauauuugcagcagucccaccaaauuuuccaacugaaggcuugagucccagccaggucacuauguucccccacauaauaguggauguuaggcaauuggaaccuguguugauccccuuaccugauguuaggaauaacuucuaccacuauaaucagucaaaugauucuaccauuaaguugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacaguuuacacugggagugcccccuuuacuccaaagcugggcaguguucaauucaguacugauacagaaaaugauuuugaaacucaccaaaacacaaaauucaccccagucgguguuauccaggaugguggcaccacccaccgaaaugaaccccaacaaugggugcucccaaguuauucagguagagauguccauaauguacaccuagccccugcuguagcccccacuuuuccgggugaacaacuucuuuucuuuagauccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5520 - RNA, 1623 nt, Artificial Sequence
  VP1__Norovirus__BAJ13678
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaacccguguugauccccuuaccugauguuaggaauaacuucuaucauuauaaucagucaaaugauucuaccauuaaacugauagcaaugcuguauacaccacuuagggccaauaaugcuggggaagacgucuucacagucucuugucgaguccucacgaggccguccccugauuuugauuuuauauuuuuggugccacccacaguugagucaagaacuaaaccauuuacugucccaauuuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucgugauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggucauaaagcuacaguuuacacugggagugcccccuuuacuccaaagcugggcaguguucaauucaguacugauacagaaaaugauuuugaagcucaccaaaacacaaaauucaccccagucggugucauccaggaugguagcaccacccaccgaaaugaaccccaacaaugggugcucccaaguuauucagguagaaauguucaaaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcccacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5521 - RNA, 1623 nt, Artificial Sequence
  VP1__Norovirus__BAJ13681
augaagauggcgucgaaugacgccagcccaucugauggguccgcagccaaccucgucccagaggucaauaaugagguuauggcuuuggagcccguugucggugccgcuauugcggcgccuguagcgggccaacaaaauguaauugaccccuggauuagaaacaauuuuguacaagccccugguggagaguucacaguguccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacugucucuugucgaguucucacgaggccauccccugauuuugauuuuauauuuuuggugccaccuacaguugagucaagaacuaaaccauuuacugucccaaucuuaacuguugaagaaaugaccaacucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucgcaacuacacaaugaauuuggccucucuaaauuggaacaauuaugacccaacagaagaaauuccagccccucuaggaacuccagauuucgugggaaagauccaaggugugcucacccaaaccacaaagggagauggcucgacccguggccauaaagcuacaguuuauacugggagugcccccuuuacuccaaagcugggcaguguucaauucaguacugauacagaaaaugauuuugaaacucaccaagacacaaaauucaccccagucggcgucauccaggaugguggcaccacccaccgaaaugaaccccaacaaugggugcucccaaguuauucagguagaaauguccagaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacgcuugcccccaugggaaauggaacggggcguagacgugcuuuauaa

SEQ ID NO: 5522 - RNA, 1623 nt, Artificial Sequence
  VP1__Norovirus__BAJ13684
augaagauggcgucgaaugacgccagcccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuugguuucucuaaauuggaacaauuaugacccaacagaagaaauuccagccccucuagggacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucaggcagaaauguccauaauguacaccuagccccugcuguagcccccacuuuuccgggugaacaacuucuuuucuuuagguccacuaugcccggauguagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcuuacaccggccagcaugauuuggucaucccccccaaugguuauuuuagguuugauuccuggguuaaucaauuuuacacacuugcccccaugggaaauggaacggggcguagacgugcuuuauaa

SEQ ID NO: 5523 - RNA, 1623 nt, Artificial Sequence
  VP1__Norovirus__BAJ13687
augaagauggcgucgaaugacgccaacccaucugauggguccgcagccaaccucgucccagaggucaacaaugaggucauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgcgggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguauacaccacuuagggccaauaaugcuggggaugaugucuucacagucuccugucgaguccucacgaggccauccccugauuuugacuuuauauuuuuggugccaccuacaguugagucaagaacuaagccauuuacugucccaaucuuaacuguugaagaaaugaccaauucaagauuccccauuccuuuggaaaaauuguucacgggucccagcagugccuuuauuguucaaccacaaaauggcagaugcacgacugauggcgugcucuuaggcaccacccaacugucuccugucaacaucugcaccuucagaggggaugucacccacauugcggguucucguaauuacacaaugaauuuggccucucuaaauuggaacaauuaugacccaacagaagaaauuccagccccucugggaacuccagauuucgugggaaagauccaaggugugcucacucaaaccacaaagggagauggcucgacccggggccauaaagcuacaguuuacacugggagugccgacuuuacuccaaaguugggcaguguucaauuugguacugauacagaaaacgauuuugaaacucaccaaaacacaaaauucaccccagucggugucauccaggaugguagcaccacccaccgaaaugaaccccaacaaugggugcucccaaguuauucaggcagaaauguccauaauguacaccuagccccugcuguagcccccaauuucccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccugacacggguaggguccuguuugagugcaaacuucauaaaucaggcuaugucacaguggcucacaccggucaacaugauuuggucaucccccccaauggcuacuuuagguuugacuccuggguuaaucaauucuacacacuugcccccaugggaaauggaacggggcguagacgugcuuuguaa

SEQ ID NO: 5524 - RNA, 1623 nt, Artificial Sequence
  VP1__Norovirus__BAJ13690
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuagaaauaacuucuaucauuauaaucagucgaaugauucuaccauuaaauugauagcaaugcuguauacaccacuuagggcuaauaaugcuggggaugaugucuucacagucucuugucgaguccucacgaggccauccccugauuuugauuucauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcuuuuaggcaccacccaacugucuccugucaacaucugcaccuucagaggggacgucacccacauugcagguucucguaauuacacaaugaauuuggcuucucuaaauuggaacaauuaugacccaacagaagaaauuccagccccucuaggaacuccagauuucguaggaaagauccaaggugugcucacucaaaccacaaagggagauggcucgacccguggccacaaagcuacaguuuacacugggagugccccuuuuacuccaaagcugggcaguguucaauucaguacugauacagaaaaugauuuugaaacccaucaaaacacaaaauucaccccagucggugucauccaggaugguagcaccacccaccgaaaugaaccccaacaauggguacucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucauuccccccaauggcuauuuuagguuugauuccuggguuaaucaauucuacacacuugcccccaugggaaauggaacggggcguaggcgugcuuuauaa

SEQ ID NO: 5525 - RNA, 1623 nt, Artificial Sequence
  VP1__Norovirus__BAJ13693
augaagauggcgucgaaugacgccaacccaucugauggguccgcagccaaccucgucccagaggucaacaaugaggucauggcuuuggagcccguugucggugccgcuauugcggcgccuguagcgggccaacaaaauguaauugaccccuggauuagaaauaauuuugugaaagccccugguggagaguucacaguauccccuagaaacucuccaggugaaauacuauggagcgcgcccuuaggcccugaucugaaucccuaccuaucucauuuggccagaauguauaaugguuaugcaggugguuuugaagugcaggugauccucgcggggaacgcguucaccgcgggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugacucuaccauuaaauugauagcaaugcuguauacaccacuuagggccaauaaugcuggggaugaugucuucacagucuccugucgaguccucacgaggccauccccugauuuugacuuuauauuuuuggugccaccuacaguugagucaagaacuaagccauuuacugucccaaucuuaacuguugaggaaaugaccaauucaagauuccccauuccuuuggaaaaauuguucacgggucccagcagugccuuuauuguucaaccacaaaauggcagaugcacgacugauggcgugcucuuaggcaccacccaacugucuccugucaacaucugcaccuucagaggggaugucacccacauugcggguucucguaauuacacaaugaauuuggccucucuaaauuggaacaauuaugacccaacagaagaaguuccagccccucugggaacuccagauuucgugggaaagauccaaggugugcucacucaaaccacaaagggagauggcucgacccggggccauaaagcuacaguuuacacugggagugccgacuuuacuccaaaguugggcaguguucaauuuggcacugauacagaaaacgauuuugaaacucaccaaaacacaaaauucaccccagucggugucauccaggaugguagcaccacccaccgaaaugaaccccaacaaugggugcucccaaguuauucaggcagaaauguccauaauguacaccuagccccugcuguagcccccaauuucccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccugacacggguaggguccuguuugagugcaaacuacauaaaucaggcuaugucacaguggcucacaccggucaacaugauuuggucaucccccccaauggcuacuuuagguuugacuccuggguuaaucaauucuacacacuugcccccaugggaaauggaacggggcguagacgugcuuuguaa

SEQ ID NO: 5526 - RNA, 1623 nt, Artificial Sequence
  VP1__Norovirus__BAJ13696
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauucccuuggaaaaauuguucacgggucccagcagugccuuuguuguucaaccacaaaauggcagaugcacgacugauggcgugcucuugggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaagauucaccccagucggugucauccaggaugguggcaccacccaccgaaaugaaccccaacagugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguguuuuauaa

SEQ ID NO: 5527 - RNA, 1623 nt, Artificial Sequence
  VP1__Norovirus__BAJ13699
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggcgaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccagguuaccauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccaucccccgauuuugauuuuauauuuuuggugccaccuacaguugagucaagaacuaaaccauuuacugucccaaucuuaacuguugaagaaaugacuaauucgagauuccccauuccuuuggaaaaguuguucacgggucccagcggugccuuuguuguucaaccacaaaauggcagaugcacgacugauggcgugcuccuaggcaccacccaacugucuccugucaacaucugcaccuucagaggggaugucacccacauugcagguucucguaacuacacaaugaauuuggcugcucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugccgacuuuacuccaaagcugggcaguguucaauucaguacugauacagaaaaugauuuugaaacucaccaaaacacaaaauucaccccagucggugucauccaggaugguagcaccacccaccgaaaugaaccccagcaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuaaucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuugguuaucccccccaauggcuauuuuagguuugauuccuggguuaaucaauucuacacacuugcccccaugggaaauggagcggggcguagacgugcuuuauaa

SEQ ID NO: 5528 - RNA, 1623 nt, Artificial Sequence
  VP1__Norovirus__BAJ13702
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccauauaauaguagauguuaggcaauuggaacccguguugauccccuuaccugauguuaggaauaacuucuaucauuauaaucagucaaaugauucuaccauuaaacugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaauuuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggucauaaagcuacaguuuacacugggagugcccccuuuacuccaaagcugggcaguguucaauucaguacugacacagaaaaugauuuugaagcucaccaaaacacaaaauucaccccagucggugucauccaggaugguagcaccacccaccgaaaugaaccccaacaaugggugcucccaaguuauucagguagaaaugcucaaaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcccacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5529 - RNA, 1623 nt, Artificial Sequence
  VP1__Norovirus__BAJ13711
augaagauggcgucgaaugacgccaacccaucugauggguccgcagccaaccucgucccagaggucaacaaugagguuauggcuuuggagcccguugucggugcggcuauugcggcgccuguagcggcccaacaaaauguaauugaccccuggauuagaaauaauuuuguacaagccccugguggagaguucacaguaucccccagaaacgcuccaagugaaauacuauggagcgcgccuuuaggcccugaucugaaccccuaccuaucucauuuugccagaauguauaauuguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaauguuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaaccccagauuucgugggaaagauccaaggagugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccugcucccccaggagugggugcagcacuucuaccaagaggcagcuccagcacaaucugauguggcucuauugagauuugugaauccagacacggguaggguccuguuugagugcaagcuucacaaaucaggcuaugucacaguggcucacaccggccagcaugauuuggucaucccccccaaugguuauuuuagguuugauuccuggguuaaucaguucuacacacuugcccccaugggaaauggaacggggcguagacgugcuuuauaa

SEQ ID NO: 5530 - RNA, 1623 nt, Artificial Sequence
  VP1__Norovirus__BAJ13714
augaagauggcgucgagugacgccaacccaucugauggguccgcagccaaccucgucccagaggucaacaaugagguuauggcuuuggagcccguugucggugccgcuauugcggcgccuguggcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcaguuccaccaaauuuuccaacugaaggcuugagucccagccaggucacuauguucccccacauaauaguagauguuaggcaauuggaaccuguguuaauccccuuaccugauguuaggaauaauuucuaucacuauaaccagucaaaugauucuaccauuaaauugauagcaaugcuguauacaccacuuagggcuaauaaugcuggggaagaugucuucacagucucuugucgaguccucacgaggccauccccugauuuugauuuuauauucuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaacuacacaaugaauuuggcuucucuaaauuggaacaauuaugacccaacagaagaaauuccagccccucuaggaacuccagauuucgugggaaagauccaagguaugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagagauguccauaauguacaccuagccccugcuguagcccccacuuucccgggugaacaacuucuuuucuucagguccacuaugcccggaugcagcggguaucccaacauggauuuggauugccuacucccccaggagugggugcagcacuucuaccaagaggcggcuccagcacaaucugauguggcucuauugagauuugugaauccagacacggguaggguccuguuugagugcaaacuucauaaaucaggcuaugucacaguggcucacaccggccagcaugauuuggucaucccccccaauggcuacuuuagguuugauuccuggguuaaucaauucuacacacuugcccccaugggaaauggaacggggcguagacgugcuuuauaa

SEQ ID NO: 5531 - RNA, 1623 nt, Artificial Sequence
  VP1__Norovirus__BAJ13717
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaacuuuccaacugaaggcuugagucccagccaggucacuauguucccccacauaauaguggauguuaggcaauuggagccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacauuuguaccuucagaggggaugucacccacguugcagguucucguaauuacauaaugaauuuggcuucucuaaauuggaauaauuaugacccaacagaagaaauuccagccccucuaggaacuccagauuucgugggaaagauccaaggugugcucacucaaaccacaaagggagaugguucgacccguggccauaaagcuacaguuuacacugggagugcccccuucacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuuuagguccacuaugcccggauguagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5532 - RNA, 1623 nt, Artificial Sequence
  VP1__Norovirus__BAJ13720
augaagauggcgucgaaugacgccaacccaucugauggguccgcagccaaccucgucccagaggucaacaaugagguuauggcuuuggagcccguugucggugccgcuauugcggcgcccguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaccagucaaaugauucuaccauuaaauugauagcaaugcuguauacaccacuuagggcuaauaaugcuggggaagaugucuuuacagucucuugucgaguucucacgaggccauccccugauuuugauuuuauauucuuggugccaccuacaguugagucaagaacuaaaccguuuacugucccaaucuuaacuguugaagaaaugaccaauucaagguucccuauuccuuuggaaaaauuguucacgggucccagcagugccuuuguuguucaaccacaaaauggcagaugcacgacugauggcgugcucuuaggcaccacccaacugucuccugucaacgucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagagaaugauuuugaaacucaccaaaacacaaaauucaccccagucggugucauccaggaugguggcaccacccaccgaaaugaaccccaacaaugggugcucccaaguuauucagguagagaugucccuaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagccccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5533 - RNA, 1623 nt, Artificial Sequence
  VP1__Norovirus__BAJ13723
augaagauggcgucgaaugacgccaacccaucugauggguccgcagccaaccucgucccagaggucaauaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaauuucuaucacuauaaucagucaaaugacucuaccauuaaauugauagcaaugcuguauacaccacuuagggcuaauaacgcuggggaagaugucuuuacagucucuugucgaguucucacgaggccauccccugauuuugauuuuauauuucuggugccaccuacagucgagucaagaacuaaaccauuuacugucccagucuuaacuguugaagaaaugaccaacucaagauuccccauuccuuuggaaaaauuguucacgggucccagcagugccuuuguuguucaaccacaaaauggcagaugcacgacugauggcgugcucuuagguaccacccaacugucuccugucaacaucugcaccuucagaggggaugucacccacauugcagguucucgugauuacacaaugaauuuggcuucucuaaacuggaacaauuaugacccaacagaagaaauuccagccccucuaggaacuccagauuucgugggaaagauccaaggugugcucacucaaaccacaaggggagauggcucgacccguggccauaaagcuacaguuuauacugggagugcccccuuuacuccaaagcugggcaguguccaauucaguacugauacagaaaaugauuuugaaacucaucaaaacacaaaauucaccccagucggugucauccaggaugguggcaccacccaccgaaaugaaccccaacaaugggugcucccaaguuauucagguagaaaugucccuaauguacacuuagccccugcuguggcccccacuuuuccgggugaacaacuucuuuucuuuagguccacuaugcccggaugcaguggguaucccaacauggauuuggauugccuacucccccaggagugggugcagcauuucuaccaagaggcagcuccagcacaaucugauguggcucuauugagauuugugaacccagacacgggaaggguccuguuugagugcaaacuucauaaaucaggcuaugucacaguggcucacaccggccagcaugauuugguuauuccccccaaugguuauuuuagguuugauuccuggguuaaucaauucuacacacuugcucccaugggaaauggaacggggcguagacgugcuuuauaa

SEQ ID NO: 5534 - RNA, 1623 nt, Artificial Sequence
  VP1__Norovirus__BAJ13726
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccgggugaaauacuauggagcgcgcccuugggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugaguccuagccaggucacuauguucccccacauaauaguggauguuaggcaauuggaaccuguguugauccccuuaccugauguuaggaauaacuucuaucacuacaaucagucaaaugauucuaccauuaaauugauagcaaugcuguauacaccacuuagggcuaauaaugcuggggaagaugucuucacagucucuugucggguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugcauuuguuguucaaccacaaaauggcagaugcacgacugauggcgugcucuuaggcaccacccaacugucuccugucaacaucugcaccuucagaggggaugucacccacauugcagguucucguaauuacacaaugaaucuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacagucuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccgaguuauucagguagaaauguccauaauguacaccuagccccugcuguagcccccacuuuuccgggugaacaacuucuuuucuuuagguccacuaugcccggaugcagcggguaucccaacauggauuuggauugccuacucccccaggaaugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5535 - RNA, 1623 nt, Artificial Sequence
  VP1__Norovirus__BAJ13729
augaagauggcgucgagugacgccaacccaucugauggguccgcagccaaccucgucccagaggucaacaaugagguuauggcuuuggagcccguugucggugccgcuauugcggcgccuguggcgggccaacaaaauguaauugaccccuggaucagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcaguuccaccaaauuuuccaacugaaggcuugagucccagccaggucacuauguucccccacauaauaguagauguuaggcaauuggaaccuguguuaauccccuuaccugauguuaggaauaauuucuaucacuauaaccagucaaaugauucuaccauuaaauugauagcaaugcuguauacaccacuuagggcuaauaaugcuggggaagaugucuucacagucucuugucgaguccucacgaggccauccccugauuuugauuuuauauucuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaacuacacaaugaauuuggcuucucuaaauuggaacaauuaugacccaacagaagaaauuccagccccucuaggaacuccagauuucgugggaaagauccaagguaugcucacucaaaccacaaagggagauggcucgacccguggccauaaagcuacaguuuacacugggagugcccccuuuacuccaaagcuaggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagagauguccauaacguacaccuagccccugcuguagcccccacuuucccgggugaacaacuucuuuucuucagguccacuaugcccggaugcagcggguaucccaacauggauuuggauugccuacucccccaggagugggugcagcacuucuaccaagaggcggcuccagcacaaucugauguggcucuauugagauuugugaauccagacacggguaggguccuguuugagugcaaacuucauaaaucaggcuaugucacaguggcucacaccggccagcaugauuuggucaucccccccaauggcuacuuuagguuugauuccuggguuaaucaauucuacacacuugcccccaugggaaauggaacggggcguagacgugcuuuauaa

SEQ ID NO: 5536 - RNA, 1623 nt, Artificial Sequence
  VP1__Norovirus__BAJ13732
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccauuuggccagaauguacaauaguuaugcaggugguuuugaagugcagguaauccucgcggggaacgcguucaccgccggaaaaaucauauuugcagcagucccaccaaauuuuccaacugaagguuugagccccagccaggucacuauguucccccauauaauaguagauguuaggcaacuggaaccuguguugauccccuuacccgauguuaggaauaauuucuaucauuacaaucaaucaaaugaccccaccaucaaauugauagcaauguuguauacaccacuuagggcuaauaaugcuggggacgaugucuucacaguuucuugucggguucucacgagaccaucccccgacuuugauuucauauuuuuagugccacccacaguugagucaagaacuaaaccauucucugucccaauuuuaacuguugaggagaugaccaacucaagauuccccauuccuuuggaaaaguuguucacgggucccagcagugccuuugucguccaaccacaaaauggcaggugcacgacugacggcgugcuccuagguacuacccaacugucuccugucaacaucugcaccuucagaggggaugucacccacauugcggguacucaagaauacacaaugaaucuggccucccaaaacuggaacaauuaugacccaacagaagagaucccagccccucugggaacuccagauuucguggguaagauccaaggcgugcucacccaaaccacaaggagggauggcucgacccgcggucacaaagccacagugagcacuggaaguguccacuucaccccaaagcugggcagaauucaauucuccacugauacaagcaaugacuuugaaacuggccaaaacacgagauucaccccagucgguguuguccaggaugguaguaccacccaccaaaaugaaccccaacaauggguacuuccaaauuauucagguagagauagucacaaugugcacuuagcccccgccguggcccccucuuuuccgggugagcaacuucuuuucuucagguccacuaugcccggaugcagcggguaucccaacaugaaucuggauugccuacucccccaggagugggugcagcacuucuaccaagaggcagccccagcacaaucugacguggcucuacuaagauuugugaauccagacacagguaggguucuguuugaguguaagcuucauaaaucaggcuaugucacaguggcucacacuggccaacaugauuuaguuaucccccccaauggcuauuuuagauuugauuccugggucaaccaguucuacacacuugcccccaugggaaauggaacggggcguagacgugcauuauaa

SEQ ID NO: 5537 - RNA, 1623 nt, Artificial Sequence
  VP1__Norovirus__BAJ13738
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccauauaauaguagauguuaggcaauuggaaccuguguugauccccuuaccugauguuaggaauaacuucuaucacuauaaucagucaaaugauucuaccauuaaauugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucccuaaauuggaacaauuaugacccaacagaagaaauuccagccccucuaggaacuccagauuuugugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5538 - RNA, 1623 nt, Artificial Sequence
  VP1__Norovirus__BAJ13741
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaacaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuagguaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccgcggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuccuuuucuucagguccacuaugcccggaugcagcggguaucccaacauggauuuggauugccuacucccucaggagugggugcagcacuucuaccaagaggcagcuccagcacaaucugauguggcucuauugagauuugugaauccagacacggguaggguccuguuugagugcaaacuucauaagucaggcuaugucacaguggcucacaccggccaguaugauuuggucaucccccccaauggcuauuuuagguuugauuccuggguuaaucaauucuacacacuugcccccaugggaaauggaacggggcguagacgugcuuuauaa

SEQ ID NO: 5539 - RNA, 1623 nt, Artificial Sequence
  VP1__Norovirus__BAJ13744
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguuuacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaacccguguugauccccuuaccugauguuaggaauaacuucuaucauuauaaucagucaaaugauucuaccauuaaacugauagcaaugcuguauacaccacuuagggccaauaaugcuggggaggaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccaucccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuauacaaugaauuuggcuucucuaaauuggaacaauuaugacccaacagaagaaauuccagccccucuaggaacuccagauuucgugggaaagauccaaggugugcucacucaaaccacaaagggagauggcucgacccguggucauaaagcuacaguuuacacugggagugcccccuuuacuccaaagcugggcaguguucaauucaguacugauacagaaaaugauuuugaagcucaccaaaacacaaaauucaccccagucggugucauccaggaugguagcaccacccaccgaaaugaaccccaacaaugggugcucccaaguuauucagguagaaauguucaaaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuacgucacaguggcccacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5540 - RNA, 1623 nt, Artificial Sequence
  VP1__Norovirus__BAJ13747
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguucacaguauccccuagaaacgcuccaggugaaauacuguggagcgcgcccuuagguccugauuugaaucccuaccuuucccauuuggccagaauguacaaugguuaugcaggugguuuugaagugcaggugauccucgcggggaacgcguucaccgccggaaagaucauauuugcagcggucccaccaaauuucccaacugaaggcuugagccccagccaggucacuauguucccccacauaauaguagauguuaggcaauuggaaccuguguugaucccccuacccgauguuaggaauaauuucuaucacuacaaccaaucaaaugaccccaccaucaaauugauagcaauguuguauacaccacuuagggccaauaaugcuggggacgaugucuucacaguuucuugucggguucucacgagaccaucccccgauuuugauuucauauuuuuaguaccacccacaguugagucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgacugauggcgugcuccuagguaccacccaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucguggggaagauucaaggugugcucacccaaaccacaagggcagauggcucgacccgcggccacaaagcuacaguguacacugggagcgccgauuuugcuccaaaacuggguagaguucaauuugccacugacacagacaaugauuuugaugcuaaccaaaacacaaaguucaccccagucggugucauccaggauggugauacugcccaccgaaaugaaccccaacaaugggugcucccaaguuacucaggcagaaauagucacaaugugcaccuggcccccgcuguagcccccacuuuuccgggugagcaacuucucuucuucagauccacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugauuugguuauuccccccaaugguuauuuuagauuugauuccugggucaaccaguucuacacacuugcccccaugggaaauggaacggggcguagacgugcauuauaa

SEQ ID NO: 5541 - RNA, 1623 nt, Artificial Sequence
  VP1__Norovirus__BAJ13750
augaagauggcgucgaaugacgccaacccaucugauggguccgcagccaaccucgucccagaggucaauaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcagguaauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaauuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagagauuccagccccucuaggaacuccagauuucgugggaaagauccaaggugugcucacucaaaccacaaagggagauggcucgacccguggccauaaagcuacaguuuauacugggagugcccccuuuacuccaaagcugggcaguguccaauucaguacugauacagaaaaugauuuugaaacucaucaaaacacaaaauucaccccagucggugucauccaggaugguggcaccacccaccgaaaugaaccccaacaaugggugcucccaaguuauucagguagaaauguuccuaauguacacuuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacgggaaggguccuguuugagugcaaacuccauaaaucaggcuaugucacaguggcucacaccggccagcaugauuugguuaucccccccaaugguuauuuuagguuugauuccuggguuaaucaauucuacacacuugcccccaugggaaauggaacggggcguagacgugcuuuauaa

SEQ ID NO: 5542 - RNA, 1623 nt, Artificial Sequence
  VP1__Norovirus__BAJ13753
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguucacaguaucuccuagaaacgcuccaggugaaauacuguggagcgcgcccuuagguccugauuugaaucccuaccuuucccauuuggccagaauguacaaugguuaugcaggugguuuugaagugcaggugauccucgcggggaacgcguucaccgccggaaagaucauauuugcagcagucccaccaaauuucccaacugaaggcuugagccccagccaggucacuauguucccccacauaauaguagauguuaggcaauuggaaccuguguugaucccccuacccgauguuaggaauaauuucuaucacuacaaccaaucaaaugaccccaccaucaaauugauagcaauguuguauacaccacuuagggccaauaaugcuggggacgaugucuucacaguuucuugucggguucucacgagaccaucccccgauuuugauuucauauuuuuaguaccacccacaguugagucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgacugauggcgugcuccuagguaccacccaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucguggggaagauucaaggugugcucacccaaaccacaagggcagauggcucgacccgcggccacaaagcuacaguguacacugggagcgccgauuuugcuccaaaacuggguagaguucaauuugccacugacacagacaaugauuuugaugcuaaccaaaacacaaaguucaccccagucggugucauccaggauggugauacugcccaccgaaaugaaccccaacaaugggugcucccaaguuacucaggcagaaauagucacaaugugcaccuggcccccgcuguagcccccacuuuuccgggugagcaacuucucuucuucagauccacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugauuugguuauuccccccaaugguuauuuuagauuugauuccugggucaaccaguucuacacacuugcccccaugggaaauggaacggggcguagacgugcauuauaa

SEQ ID NO: 5543 - RNA, 1623 nt, Artificial Sequence
  VP1__Norovirus__BAJ13756
augaagauggcgucgagugacgccaacccaccugauggguccgcagccaaccucgucccagaggucaacaaugagguuauggcuuuggagcccguugucggugccgcuauugcggcgccuguggcgggccaacaaaauguaauugaccccuggauuagaaauaauuuugugcaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcaguuccaccaaauuuuccaacugaaggcuugagucccagccaggucacuauguucccccacauaauaguagauguuaggcaauuggaaccuguguuaauccccuuaccugauguuaggaauaauuucuaucacuauaaccagucaaaugauucuaccauuaaauugauagcaaugcuguauacaccacuuagggcuaauaaugcuggggaagaugucuucacagucucuugucgaguccucacgaggccauccccugauuuugauuuuauauucuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguagcuacacaaugaauuuggcuucucuaaauuggaacaauuaugacccaacagaagaaauuccagccccucuaggaacuccagauuucgugggaaagauccaagguaugcucacucaaaccacaaagggagauggcucgacccguggccauaaagcuacaguuuacacugggagugcccccuuuacuccaaagcugggcaguguucaauucaguacugauacagaaaaugauuuucaaacucaccaaaacacaaaauucaccccagucggugucauccaggaugguagcaccacccaccgaaaugaaccccaacaaugggugcucccaaguuauucagguagagauguccauaauguacaccuagccccugcuguagcccccacuuucccgggugaacaacuucuuuucuucagguccacuaugcccggaugcagcggguaucccaacauggauuuggauugccuacucccccaggagugggugcagcacuucuaccaagaggcggcuccagcacaaucugauguggcucuauugagauuugugaauccagacacggguaggguccuguuugagugcaaacuucauaaaucaggcuaugucacaguggcucacaccggccagcaugauuuggucaucccccccaauggcuacuuuagguuugauuccuggguuaaucaauucuacacacuugcccccaugggaaauggaacggggcguagacgugcuuuauaa

SEQ ID NO: 5544 - RNA, 1623 nt, Artificial Sequence
  VP1__Norovirus__BAJ13759
augaagauggcgucgaaugacgccaacccaucugauggguccgcagccagccucgucccagaggucagcaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggccugagucccagccaggucaccauguucccccacauaauaguagauguuaggcaauuggaaccuguguugauccccuuaccugauguuaggaauaauuucuaucacuauaaucagucaaaugauucuaccauuaaauugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaauaauuaugacccaacagaagaaauuccagccccucugggaacuccagauuucgugggaaagauccaaggugugcucacucaaaccacaaagggagauggcucgacccguggccauaaagcuacaguuuacacugggagugcccccuuuacuccaaagcuggguaguguucaauucaguacugauacagaaaaugauuuugaaacucaccaaaacacaaaauucaccccagucggugucauccaggaugguagcaccacccaccgaaaugaaccccaacaaugggugcucccaaguuacucagguagagauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcccuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacucgcccccaugggaaauggaacggggcguagacgugcuuuauaa

SEQ ID NO: 5545 - RNA, 1623 nt, Artificial Sequence
  VP1__Norovirus__BAJ13762
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaauguuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaaccccagauuucgugggaaagauccaaggagugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccugcucccccaggagugggugcagcacuucuaccaagaggcagcuccagcacaaucugauguggcucuauugagauuugugaauccagacacggguaggguccuguuugagugcaagcuucacaaaucaggcuaugucacaguggcucacaccggccagcaugauuuggucaucccccccaaugguuauuuuagguuugauuccuggguuaaucaguucuacacacuugcccccaugggaaauggaacggggcguagacgugcuuuauaa

SEQ ID NO: 5546 - RNA, 1623 nt, Artificial Sequence; identical to SEQ ID NO: 5545
  VP1__Norovirus__BAJ13765

SEQ ID NO: 5547 - RNA, 1623 nt, Artificial Sequence
  VP1__Norovirus__BAJ13768
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuugggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugaguccuagccaggucacuauguucccccacauaauaguggauguuaggcaauuggaaccuguguugauccccuuaccugauguuaggaauaacuucuaucacuacaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaacggcagaugcacgacugauggcgugcucuuaggcaccacccaacugucuccugucaacaucugcaccuucagaggggaugucacccacauugcagguucucguaauuacacaaugaaucuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacagucuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccgaguuauucagguagaaauguccauaauguacaccuagccccugcuguagcccccacuuuuccgggugaacaacuucuuuucuuuagguccacuaugcccggaugcagcggguaucccaacauggauuuggauugccuacucccccaggaaugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5548 - RNA, 1623 nt, Artificial Sequence
  VP1__Norovirus__BAJ13771
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcagccuuaggcccugaucugaaucccuaucuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucccuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5549 - RNA, 1623 nt, Artificial Sequence
  VP1__Norovirus__BAJ13774
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuacgcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaacccguguugauccccuuaccugauguuaggaauaacuucuaucauuauaaucagucaaaugauucuaccauuaaacugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaauuuuaacuguugaagaaaugaccaauucaagauuccccaucccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggucauaaagcuacaguuuacacugggagugcccccuuuacuccaaagcugggcaguguucaauucaguacugauacagaaaaugauuuugaagcucaccaaaacacaaaauucaccccagucggugucauccaggaugguagcaccacccaccgaaaugaaccccaacaaugggugcucccaaguuauucagguagaaauguucaaaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcccacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5550 - RNA, 1623 nt, Artificial Sequence
  VP1__Norovirus__BAJ13777
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaacccguguugauccccuuaccugauguuaggaauaacuucuaucauuauaaucagucaaaugauucuaccauuaaacugauagcaaugcuguauacaccacuuagggccaauaaugcuggggacgaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccaucccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggucauaaagcuacaguuuacacugggagugcccccuuuacuccaaagcugggcaguguucaauucaguacugauacagaaaaugauuuugaagcucaccaaaacacaaaauucaccccagucggugucauccaggaugguagcaccacccaccgaaaugaaccccaacaaugggugcucccaaguuauucagguagaaauguucaaaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcccacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5551 - RNA, 1623 nt, Artificial Sequence
  VP1__Norovirus__BAJ13780
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaacccguguugauccccuuaccugauguuaggaauaacuucuaucauuauaaucagucaaaugauucuaccauuaaacugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaauuuuaacuguugaagaaaugaccaauucaagauuccccaucccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggucauaaagcuacaguuuacacugggagugcccccuuuacuccaaagcugggcaguguucaauucaguacugauacagaaaaugauuuugaagcucaccaaaacacaaaauucaccccagucggugucauccaggaugguagcaccacccaccgaaaugaaccccaacaaugggugcucccaaguuauucagguagaaauguccaaaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcccacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5552 - RNA, 1623 nt, Artificial Sequence
  VP1__Norovirus__BAJ13783
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugagucccagccaggucacuauguucccccacauaauaguagauguuaggcaauuggaacccguguugauccccuuaccugauguuaggaauaacuucuaucauuauaaucagucaaaugauucuaccauuaaacugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaauuuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucagaccacgaagggagauggcucgacccguggucauaaagcuacaguuuacacugggagugcccccuucacuccaaagcugggcaguguucaauucaguacugauacagaaaaugauuuugaagcucaccaaaacacaaaauucaccccagucggugucauccaggaugguagcaccacccaccgaaaugaaccccaacaaugggugcucccaaguuauucagguagaaauguucaaaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagauacggguaggguccuguuugagugcaaacuucauaaaucaggcuaugucacaguggcccacaccggccagcaugauuuggucauccccccuaauggcuauuuuagguuugauuccuggguuaaucaauucuacacacuugcccccaugggaaauggaacggggcguagacgugcuuuauaa

SEQ ID NO: 5553 - RNA, 1623 nt, Artificial Sequence
  VP1__Norovirus__BAJ13786
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaauguuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaaccccagauuucgugggaaagauccaaggagugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccugcucccccaggagugggugcagcacuucuaccaagaggcagcuccagcacaaucugauguggcgcuauugagauuugugaauccagacacggguaggguccuguuugagugcaagcuucacaaaucaggcuaugucacaguggcucacaccggccagcaugaucuggucaucccccccaaugguuauuuuagguuugauuccuggguuaaucaguucuacacacuugcccccaugggaaauggaacggggcguagacgugcuuuauaa

SEQ ID NO: 5554 - RNA, 1623 nt, Artificial Sequence
  VP1__Norovirus__BAJ13792
augaagauggcgucgaaugacgccaacccaucugauggguccgcagccaaccucgucccagaggucaacaaugagguuauggcuuuggagcccguugucggugcugcuauugcggcgccuguagcgggccaacaaaauguaauugaccccuggauuagaaauaauuuuguacaagccccugguggagaguucacaguaucuccuaggaacgcuccaggugaaauacuauggagcgcucccuuaggcccugaucugaaucccuaccuaucucauuuggccagaauguauaaugguuaugcaggugguuuugaagugcaggugguccucgcggggaacgcguucaccgccggaaaaguuauauuugcagcagucccaccaaauuuuccaacugaaggcuugagccccagucaggucacuauguucccccacauaauaguagauguuaggcaauuggagcccguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaacucaagauucccuauuccuuuggaaaaguuguucacgggucccagcggugccuuuguuguucaaccacaaaauggcagaugcacgacugauggcgugcucuuagguaccacccaacugucuccugucaacaucugcaccuucagaggggaugucacccacauugcagguucucguaauuacacaaugaacuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggaguacccccuuuacuccaaagcugggcaguguucaauucagcacugauacagaaaaugauuuugaaaaucaccaaaacacaaaauuuaccccagucggugucauccaggaugguggcaccacccaccgaaaugaaccccaacaaugggugcucccaaguuauucagguagaaauguccaaaauguacaccuagccccugcuguagcccccacuuuuccgggugaacaacuucuuuucuucagguccacuaugcccggaugcagcggguauccuaacauggaucuggauugccuacucccccaggaguggguacagcacuucuaccaagaggcagcuccagcacaaucugauguggcucuacugagauuugugaauccagauacggguaggguccuguuugagugcaaacuccauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5555 - RNA, 1623 nt, Artificial Sequence
  VP1__Norovirus__BAJ13795
augaagauggcgucgaaugacgccaacccaucugauggguccgcagccaaccucgucccagaggucaacaaugagguuauggcuuuggagcccguugucggugcugcuauugcggcgccuguagcgggccaacaaaauguaauugaccccuggauuagaaauaauuuuguacaagccccugguggagaguucacaguaucuccuaggaacgcuccaggugaaauaccauggagcgcucccuuaggcccugaucugaaucccuaccuaucucauuuggccagaauguauaaugguuaugcaggugguuuugaagugcaggugguccucgcggggaacgcguucaccgccggaaaaguuauauuugcagcagucccaccaaauuuuccaacugaaggcuugagccccagucaggucacuauguucccccacauaauaguagauguuaggcaauuggagcccguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaacucaagauucccuauuccuuuggaaaaguuguucacgggucccagcggugccuuuguuguucaaccacaaaauggcagaugcacgacugauggcgugcucuuagguaccacccaacugucuccugucaacaucugcaccuucagaggggaugucacccacauugcagguucucguaauuacacaaugaacuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggaguacccccuuuacuccaaagcugggcaguguucaauucagcacugauacagaaaaugauuuugaaaaucaccaaaacacaaaauuuaccccagucggugucauccaggaugguggcaccacccaccgaaaugaaccccaacaaugggugcucccaaguuauucagguagaaauguccaaaauguacaccuagccccugcuguagcccccacuuuuccgggugaacaacuucuuuucuucagguccacuaugcccggaugcagcggguauccuaacauggaucuggauugccuacucccccaggaguggguacagcacuucuaccaagaggcagcuccagcacaaucugauguggcucuacugagauuugugaauccagauacggguaggguccuguuugagugcaaacuccauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5556 - RNA, 1623 nt, Artificial Sequence
  VP1__Norovirus__BAJ13801
augaagauggcgucgaaugacgccaacccaucugauggguccgcagccaaccucgucccagaggucaacaaugagguuauggcuuuggagcccguugucggugcugcuauugcggcgccuguagcgggccaacaaaauguaauugaccccuggauuagaaauaauuuuguacaagccccugguggagaguucacaguaucuccuaggaacgcuccaggugaaauacuauggagcgcucccuuaggcccugaucugaaucccuaccuaucucauuuggccagaauguauaaugguuaugcaggugguuuugaagugcaggugguccucgcggggaacgcguucaccgccggaaaaauuauauuugcagcagucccaccaaauuuuccaacugaaggcuugagccccagucaggucacuauguucccccacauaauaguagauguuaggcaauuggagcccguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaacucaagauucccuauuccuuuggaaaaguuguucacgggucccagcggugccuuuguuguucaaccacaaaauggcagaugcacgacugauggcgugcucuuagguaccacccaacugucuccugucaacaucugcaccuucagaggggaugucacccacauugcagguucucguaauuacacaaugaacuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggaguacccccuuuacuccaaagcugggcaguguucaauucagcacugauacagaaaaugauuuugaaaaucaccaaaacacaaaauuuaccccagucggugucauccaggaugguggcaccacccaccgaaaugaaccccaacaaugggugcucccaaguuauucagguagaaauguccaaaauguacaccuagccccugcuguagcccccacuuuuccgggugaacaacuucuuuucuucagguccacuaugcccggaugcagcggguauccuaacauggaucuggauugccuacucccccaggaguggguacagcacuucuaccaagaggcagcuccagcacaaucugauguggcucuacugagauuugugaauccagauacggguaggguccuguuugagugcaaacuccauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5557 - RNA, 1623 nt, Artificial Sequence
  VP1__Norovirus__BAJ13804
augaagauggcgucgaaugacgccaacccaucugauggguccgcagccaaccucgucccagaggucaacaaugagguuauggcuuuggagcccguugucggugccgcuauugcggcgccuguagcgggccagcaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccucacauaauaguggauguuaggcaauuggaaccuguguugauccccuuaccugauguuaggaauaacuucuaucacuacaaucagucaaaugauucuaccauuaaauugauagcaaugcuauauacaccacuuagggcuaacaaugcuggggaggaugucuucacagucucuugucgaguccucacgaggccauccccugauuuugauuuuauauuuuuggugccaccuacagucgagucaagaacuaaaccauuuacugucccaaucuuaacuguugaagaaaugaccaauucaagauuccccauuccuuuggaaaaauuguucacgggccccagcagugccuucguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacaguuuacacugggagugcccccuuuacuccaaagcuggguaguguucaguucaguacugauacagaaaaugauuucgaaacucaccaaaacacaaaauucaccccagucggugucauccaggaugguggcaccacccaccgaaaugaaccccaacaaugggugcucccaaguuauucagguagaaauguccaaaauguacaccuagccccugcuguagcccccacuuuuccgggugaacaacuucuuuucuuuagguccacuaugcccggaugcagcggguauccuaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuacgucacaguggcucauaccggucagcaugauuuggucaucccccccaaugguuauuuuagguuugauuccuggguaaaucaauucuacacacuugcccccaugggaaauggaacggggcgcagacgugcuuuauaa

SEQ ID NO: 5558 - RNA, 1623 nt, Artificial Sequence
  VP1__Norovirus__BAJ13807
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauucgcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaauguuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaaccccagauuucgugggaaagauccaaggagugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccugcucccccaggagugggugcagcacuucuaccaagaggcagcuccagcacaaucugauguggcucuauugagauuugugaauccagacacggguaggguccuguuugagugcaagcuucauaaaucaggcuaugucacaguggcucacaccggccagcaugauuuggucaucccccccaaugguuauuuuagguuugauuccuggguuaaucaguucuacacacuugcccccaugggaaauggaacggggcguagacgugcuuuauaa

SEQ ID NO: 5559 - RNA, 1623 nt, Artificial Sequence; identical to SEQ ID NO: 5557
  VP1__Norovirus__BAJ13810

SEQ ID NO: 5560 - RNA, 1623 nt, Artificial Sequence; identical to SEQ ID NO: 5557
  VP1__Norovirus__BAJ13816

SEQ ID NO: 5561 - RNA, 1623 nt, Artificial Sequence
  VP1__Norovirus__BAJ13819
augaagauggcgucgaaugacgccaacccaucugauggguccgcagccaaccucgucccagaggucaacaaugagguuauggcuuuggagcccguugucggugccgcuauugcggcgccuguggcgggccaacaaaauguaauugaccccuggauuagaaauaauuuuguacaagccccugguggagaguucacaguauccccuagaaacgcuccaggcgagauauuguggagcgcgcccuuaggcccugaucugaaucccuaccuaucucauuuggccagaauguauaaugguuaugcaggugguuuugaagugcaggugauccucgcggggaacgcguucaccgccggaaagauuauauuugcagcagucccaccaaacuuuccaacugaaggcuugagccccagccagguuacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccaucccccgauuuugauuuuauauuuuuggugccaccuacaguugagucaagaacuaaaccauuuacugucccaaucuuaacuguugaagaaaugacuaauucaagauuccccauuccuuuggaaaaguuguucacgggucccagcggugccuuuguuguucaaccacaaaauggcagaugcacgacugauggcgugcuccuaggcaccacccaacugucuccugucaacaucugcaccuucagaggggaugucauccacauugcagguucucguaacuacacaaugaauuuggcugcucuaaauuggaacaauuaugacccaacagaagaaauuccagccccucuaggaaccccagauuucgugggaaagauccaaggugugcucacucaaaccacaaagggagauggcucgacccguggccauaaagcuacaguuuacacugggagugccgacuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccaccuuuccgggugaacaacuucuuuucuucagguccacuaugcccggaugcagcggguaucccaacauggauuuggauugccuacucccccaagagugggugcagcacuucuaccaagaggcagcuccagcacaaucugauguggcucuauugagauuugugaauccagacacggguaggguccuguuugagugcaaacuccauaaaucagguuaugucacaguggcucacaccggccagcaugacuuggucaucccccccaauggcuacuuuagguuugauuccuggguuaaucaauucuacacacuugcccccaugggaaauggaacggggcguagacgugcuuuauaa

SEQ ID NO: 5562 - RNA, 1623 nt, Artificial Sequence; identical to SEQ ID NO: 5557
  VP1__Norovirus__BAJ13822

SEQ ID NO: 5563 - RNA, 1623 nt, Artificial Sequence
  VP1__Norovirus__BAJ13825
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaacccguguugauccccuuaccugauguuaggaauaacuucuaucauuauaaucagucaaaugauucuaccauuaaacugauagcaaugcuguauacaccacuuagggccaauaaugcuggggaagacgucuucacagucucuugucgaguccucacgaggccguccccugauuuugauuuuauauuuuugacaccacccacaguugagucaagaacuaaaccauuuacugucccaauuuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggucauaaagcuacaguuuacacugggagugcccccuuuacuccaaagcugggcaguguucaauucaguacugauacagaaaaugauuuugaagcucaccaaaacacaaaauucaccccagucggugucauccaggaugguagcaccacccaccgaaaugaaccccaacaaugggugcucccaaguuauucagguagaaauguucaaaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugacuuggcuuuauugagauuugugaauccagacacggguaggguccuguuugagugcaaacuucauaaaucaggcuaugucacaguggcccacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5564 - RNA, 1623 nt, Artificial Sequence
  VP1__Norovirus__BAJ13828
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaauguuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaaccccagauuucgugggaaagauccaaggagugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacacucucuauacuuuagguccacuaugcccggaugcagcggguaucccaacauggauuuggauugccugcucccccaggagugggugcagcacuucuaccaagaggcagcuccagcacaaucugauguggcgcuauugagauuugugaauccagacacggguaggguccuguuugagugcaagcuucacaaaucaggcuaugucacaguggcucacaccggccagcaugaucuggucaucccccccaaugguuauuuuagguuugauuccuggguuaaucaguucuacacacuugcccccaugggaaauggaacggggcguagacgugcuuuauaa

SEQ ID NO: 5565 - RNA, 1623 nt, Artificial Sequence; identical to SEQ ID NO: 5553
  VP1__Norovirus__BAJ13831

SEQ ID NO: 5566 - RNA, 1623 nt, Artificial Sequence
  VP1__Norovirus__BAJ13834
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuagaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaacuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuucacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcucacaccggccagcaugauuuggucaucccccccaauggcuauuuuagguuugauuccugggucaaucaauucuacacacuugcccccaugggaaauggaacggggcguagacgugcuuuauaa

SEQ ID NO: 5567 - RNA, 1623 nt, Artificial Sequence
  VP1__Norovirus__BAJ13837
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugagucccagccaggucacuauguucccccacauaauaguggauguuaggcaauuggaaccuguguugaucccccuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggccucucuaaauuggaacaauuaugacccaacagaagaaauuccagccccucuaggaacuccagauuuugugggaaagauccaaggugugcucacucaaaccacaaagggagauggcucgacccguggccauaaagcuacaguuuacacugggagugcccccuuuacuccaaagcugggcaguguccaauucaguacugauacagagaaugauuuugaaacucaccaaaacacaaaguucaccccagucggugucauccaggaugguggcaccacccaucgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccuacucccccaggagugggugcagcacuucuaccaagaagcagcuccggcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauuuuacacacuugcccccaugggaaauggaacggggcguagacgugcuuuauaa

SEQ ID NO: 5568 - RNA, 1623 nt, Artificial Sequence
  VP1__Norovirus__BAJ13840
augaagauggcgucgaaugacgccagcccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggcgaaauauuguggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccagguuaccauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccaucccccgauuuugauuuuauauuuuuggugccaccuacaguugagucaagaacuaaaccauuuacugucccaaucuuaacuguugaagaaaugacuaauucaagauuccccauuccuuuggaaaaguuguucacgggucccagcggugccuuuguuguucaaccacaaaauggcagaugcacgacugauggcgugcuccuaggcaccacccaacugucuccugucaacaucugcaccuucagaggggaugucacccacauugcggguucucguaacuacacaaugaauuuggcugcucugaauuggaacaauuacgacccaacagaagaaauuccagccccucuaggaaccccagauuucgugggaaagauccaaggugugcucacucaaaccacaaaggcagauggcucgacccguggccauaaagcuacaguuuacacugggagugccgucuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccaccuuuccgggugaacaacuucuuuucuucagguccacuaugcccggaugcagcggguaucccaacauggauuuggauugccuacucccccaagagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugacuuggucaucccccccaauggcuauuuuagguuugauuccuggguuaaucaauucuacacacuugcccccaugggaaauggaacggggcguagacgugcuuuauaa

SEQ ID NO: 5569 - RNA, 1623 nt, Artificial Sequence
  VP1__Norovirus__BAJ13843
augaagauggcgucgaaugacgccaacccaucugauggguccgcagccaaccucgucccagaggucaauaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaauuucuaucacuauaaucagucaaaugauucuaccauuaaacugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuauacugggagugcccccuuuacuccaaagcugggcaguguccaauucaguacugauacagaaaaugauuuugaaacucaucaaaacacaaaauucaccccagucggugucauccaggaugguggcaccacccaccgaaaugaaccccaacaaugggugcucccaaguuauucagguagaaaugucccuaauguacacuuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacgggaaggguccuguuugagugcaaacuccauaaaucaggcuaugucacaguggcucacaccggccagcaugauuugguuaucccccccaaugguuauuuuagguuugauuccuggguuaaucaauuuuacacacuugcccccaugggaaauggaacggggcguagacgugcuuuauaa

SEQ ID NO: 5570 - RNA, 1623 nt, Artificial Sequence
  VP1__Norovirus__BAJ13846
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaauguuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagagaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaaccccagauuucgugggaaagauccaaggagugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccugcucccccaggagugggugcagcacuucuaccaagaggcagcuccagcacaaucugauguggcucuauugagauuugugaauccagacacggguaggguccuguuugagugcaagcuucacaaaucaggcuaugucacaguggcucacaccggccagcaugauuuggucaucccccccaaugguuauuuuagguuugauuccuggguuaaucaguucuacacacuugcccccaugggaaauggaacggggcguagacgugcuuuauaa

SEQ ID NO: 5571 - RNA, 1623 nt, Artificial Sequence
  VP1__Norovirus__BAJ13849
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaacaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucacugccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaccauuauaaccagucaaaugauucuaccauuaaauugauagcaauguuguauacaccacuuagggcuaauaaugcuggggaagacgucuuuacagucucuugucgaguucucacgaggccauccccugauuuugauuuuauauucuuggugccaccuacaguugagucaagaacuaaaccauuuacugucccaaucuuaacuguugaagaaaugacuaauucaagauuccccauuccuuuggaaaaauuguucacgggucccagcagugccuuuguuguucaaccacaaaauggcagaugcacgacugauggcgugcucuuaggcaccacccaacuguccccugucaauaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguccaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccaggugagcaacuucuuuucuuuagguccacuaugcccggaugcagcggguaucccaacauggauuuggauugccugcucccccaggagugggugcagcacuucuaccaagaggcagcuccagcacaaucugauguggcucuauugagauuugugaauccagacacggguaggguccuguuugagugcaaacuucacaaaucaggcuaugucacaguggcucacaccggccagcaugauuuggucaucccccccaauggcuauuuuagguuugauuccuggguuaaucaguucuacacacuugcccccaugggaaauggaacggggcguagacgugcuuuauaa

SEQ ID NO: 5572 - RNA, 1623 nt, Artificial Sequence
  VP1__Norovirus__BAJ13852
augaagauggcgucgaaugacgccaacccaucugauggguccgcagccaaccucgucccagaggucaauaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauuuuugcagcagucccaccaaauuuuccaacugaaggcuugagucccagccaggucacuauguucccccacauaauaguggauguuaggcaauuggaaccuguguugauccccuuaccugauguuaggaauaauuucuaucauuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuauacugggagugcccccuuuacuccaaagcugggcaguguccaauucaguacugauacagaaaaugauuuugaaacucaucaaaacacaaaauucaccccagucggugucauccaggaugguggcaccacccaccgaaaugaaccccaacaaugggugcucccaaguuauucagguagaaaugucccuaauguacacuuagccccugcuguagcccccacuuuuccgggugaacagcuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacgggaaggguccuguuugagugcaaacuccauaaaccaggcuaugucacaguggcucacaccggccagcaugauuugguuauccccuccaauggcuauuuuagguuugauuccuggguuaaucaauucuacacacuugcccccaugggaaauggaacggggcguagacgugcuuuauaa

SEQ ID NO: 5573 - RNA, 1623 nt, Artificial Sequence
  VP1__Norovirus__BAJ13855
augaagauggcgucgaaugacgccaacccaucugauggguccgcagccaaccucgucccagaggucaauaaugagguuauggcuuuggaucccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccaggucacuauguucccccacauaauaguggauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauguuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuauacugggagugcccccuuuacuccaaagcugggcaguguccaauucaguacugauacagaaaaugauuuugaaacucaucaaaacacaaaauucaccccagucggugucauccaggaugguggcaccacccaccgaaaugaaccccaacaaugggugcucccaaguuauucagguagaaaugucccuaauguacacuuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacgggaaggguccuguuugagugcaaacuucauaaaucaggcuaugucacaguggcacacaccggccagcaugauuuggucaucccccccaaugguuauuuuagguuugauuccuggguuaaucaauucuauacacuugcccccaugggaaauggaacggggcguagacgugcuuuauaa

SEQ ID NO: 5574 - RNA, 1623 nt, Artificial Sequence
  VP1__Norovirus__BAJ13858
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucuaaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccacccacaguugagucaagaacuaaaccauucacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacgaagggagauggcucgacccguggccauaaagcuacaguuuacacugggagugcccccuucacuccaaagcugggcaguguucaguucaguacugauacagaaaaugauuuugaaacucaccaaaacacaaaauucaccccagucggugucauccaggaugguagcaccacccaccgaaaugaaccccaacaauggguacucccaaguuauucagguagaaauguccauaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuccauaaaucagguuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5575 - RNA, 1623 nt, Artificial Sequence
  VP1__Norovirus__BAJ13861
augaagaugaggucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuucguacaagccccugguggagaguucacaguauccccuagaaacgcuccaggugaaauacuguggagcgcgcccuuagguccugauuugaaucccuaccuuucccauuuggccagaauguacaaugguuaugcaggugguuuugaagugcaggugauccucgcggggaacgcguucaccgccggaaagaucauauuugcagcagucccaccaaauuucccaacugaaggcuugagccccagccaggucacuauguucccccacauaauaguagauguuaggcaauuggaaccuguguugaucccccuacccgauguuaggaauaauuucuaucacuacaaccaaucaaaugaccccaccaucaaauugauagcaauguuguauacaccacuuagggccaauaaugcuggggacgaugucuucacagguucuugucggguucucacgagaccaucccccgauuuugauuucauauuuuuaguaccacccacaguugagucaagaacuaaaccauucucugucucauuuuuuacuggugaggagaugaccaauucaagauuccccauuccuuuggaaaagcuguucacgggucccagcagugccuuuguuguucaaccacaaaacggcaggugcacgacugauggcgugcuccuagguaccacccaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucguggggaagauucaaggugugcucacccaaaccacaagggcagauggcucgacccgcggccacaaagcuacaguguacacugggagcgccgauuuugcuccaaaacuggguagaguucaauuugccacugacacagacaaugauuuugaugcuaaccaaaacacaaaguucaccccagucggugucauccaggauggugauacugcccaccgaaaugaaccccaacaaugggugcucccaaguuacucaggcagaaauagucacaaugugcaccuggcccccgcuguagcccccacuuuuccgggugagcaacuucucuucuucagauccacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugauuugguuauuccccccaaugguuauuuuagauuugauuccugggucaaccaguucuacacacuugcccccaugggaaauggaacggggcguagacgugcauuauaa

SEQ ID NO: 5576 - RNA, 1623 nt, Artificial Sequence
  VP1__Norovirus__BAJ13864
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugagucccagccaggucacuauguucccccacauaauaguggauguuagacaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuucauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaauaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaguucaguacugauacagaaaaugauuuugaaacucaccaaaacacaaaauucaccccagucggugucauccaggaugguagcaccacccaccgaaaugaaccccaacaauggguacucccaaguuauucagguagaaauguccauaauguacaccuagccccugcuguagcccccacuuuuccgggugaacaacuucuuuucuuuagguccacuaugccuggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuccauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5577 - RNA, 1623 nt, Artificial Sequence
  VP1__Norovirus__BAJ13867
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuucguacaagccccugguggagaguucacaguauccccuagaaacgcuccaggugaaauacuguggagcgcgcccuuagguccugauuugaaucccuaccuuucccauuuggccagaauguacaaugguuaugcaggugguuuugaagugcaggugauccucgcggggaacgcguucaccgccggaaagaucauauuugcagcagucccaccaaauuucccaacugaaggcuugagccccagccaggucacuauguucccccacauaauaguagauguuaggcaauuggaaccuguguugaucccccuacccgauguuaggaauaauuucuaucacuacaaccaaucaaaugaccccaccaucaaauugauagcaauguuguauacaccacuuagggccaauaaugcuggggacgaugucuucacaguuucuugucggguucucacgagaccaucccccgauuuugauugcauauuagaccuaccacccacaguugagucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgacugauggcgugcuccuagguaccacccaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucguggggaagauucaaggugugcucacccaaaccacaagggcagauggcucgacccgcggccacaaagcuacaguguacacugggagcgccgauuuugcuccaaaacuggguagaguucaauuugccacugacacagacaaugauuuugaugcuaaccaaaacacaaaguucaccccagucggugucauccaggauggugauacugcccaccgaaaugaaccccaacaaugggugcucccaaguuacucaggcagaaauagucacaaugugcaccuggcccccgcuguagcccccacuuuuccgggugagcaacuucucuucuucagauccacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugauuugguuauuccccccaaugguuauuuuagauuugauuccugggucaaccaguucuacacacuugcccccaugggaaauggaacggggcguagacgugcauuauaa

SEQ ID NO: 5578 - RNA, 1623 nt, Artificial Sequence
  VP1__Norovirus__BAJ13873
augaagauggcgucgagugacgccaacccaucugauggguccgcagccaaccucgucccagaggucaacaaugagguuauggcuuuggagcccguuguuggugccgcuauugcggcgccuguagcgggccaacaaaauguaauugaccccuggauuagaaauaauuuuguacaagccccugguggagaguucacaguaucuccuagaaacgcuccaggugaaauacuauggagcgcgcccuuagguccugaucugaaucccuaccuaucucauuuggccagaauguacaaugguuaugcaggugguuuugaagugcaggugauccucgcggggaacgcguucaccgccggaaagauuauauuugcagcagucccaccaaauuucccaacugaaggcuugagucccagccaggucacuauguucccccacauaauaguggauguuaggcaauuggaaccuguguugauccccuuaccugauguuaggaauaauuucuaucauuauaaucagucaaaugauucuaccauuaaauugauagcaaugcuguauacaccacuuagggcuaauaaugcuggggaaguugucuuuacagucucuugucgaguucucacgaggccauccccugauuuugauuuuauaugcuuggugccaccuacaguugagucaagaacuaaaccauuuacugucccaaucuuaacuguugaggaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuauacugggagugcccccuuuacuccaaagcugggcaguguccaauucaguacugauacagaaaaugauuuugaaacucaucaaaacacaaaauucaccccagucggugucauccaggaugguggcaccacccaccgaaaugaaccccaacaaugggugcucccaaguuauucagguagaaaugucccuaauguacacuuagccccugcuguagcccccacuuuuccgggugaacagcuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacgggaaggguccuguuugagugcaaacuccauaaaccaggcuaugucacaguggcucacaccggccagcaugauuugguuauccccuccaaugguuauuuuagguuugauuccuggguuaaucaauucuacacacuugcccccaugggaaauggaacggggcguagacgugcuuuauaa

SEQ ID NO: 5579 - RNA, 1623 nt, Artificial Sequence
  VP1__Norovirus__BAJ13876
augaagauggcgucgaaugacgccaacccaucugauggguccgcagccaaccucgucccagaggucaacaaugagguuauggcuuuggagcccguugucggugccgcuauugcggcgccuguggcgggccaacaaaauguaauugaccccuggauuagaaauaauuuuguacaagccccugguggagaguucacaguguccccuagaaacgcuccaggugagauauuguggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccagguuacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccaucccccgauuuugauuuuauauuuuuggugccaccuacaguugagucaagaacuaaaccauuuacugucccaaucuuaacuguugaagaaaugacuaauucaagauuccccauuccuuuggaaaaguuguucacgggucccagcggugccuuuguuguucaaccacaaaauggcagaugcacgacugauggcgugcuccuaggcaccacccaacugucuccugucaacaucugcaccuucagaggggaugucacccacauugcagguucucguaacuacacaaugaauuuggcugcucuaaauuggaacaauuaugacccaacagaagaaauuccagccccucuaggaaccccagauuucgugggaaagauccaaggugugcucacucaaaccacaaagggagauggcucgacccguggccauaaagcuacaguuuacacugggagugccgacuuuacuccaaaguugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccaccuuuccgggugaacaacuucuuuucuucagguccacuaugcccggaugcagcggguaucccaacauggauuuggauugccuacucccccaagagugggugcagcacuucuaccaagaggcagcuccagcacaaucugauguggcucuauugagauuugugaauccagacacggguaggguccuguuugagugcaaacuccauaaaucagguuaugucacaguggcucacaccggccagcaugacuuggucaucccccccaauggcuauuuuagguuugauuccuggguuaaucaauucuacacacuugcccccaugggaaauggaacggggcguagacgugcuuuauaa

SEQ ID NO: 5580 - RNA, 1623 nt, Artificial Sequence
  VP1__Norovirus__BAJ13879
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugaucccccuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaauggauuuggccucucuaaauuggaacaauuaugacccaacagaagaaauuccagccccucuaggaacuccagauuuugugggaaagauccaaggugugcucacucaaaccacaaagggagauggcucgacccguggccauaaagcuacaguuuacacugggagugcccccuuuacuccaaagcugggcaguguccaauucaguacugauacagagaaugauuuugaaacucaccaaaacacaaaguucaccccagucggugucauccaggaugguggcaccacccaucgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccuacucccccaggagugggugcagcacuucuaccaagaagcagcuccggcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauuuuacacacuugcccccaugggaaauggaacggggcguagacgugcuuuauaa

SEQ ID NO: 5581 - RNA, 1623 nt, Artificial Sequence
  VP1__Norovirus__BAJ13882
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaacugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaacuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccacuuuuccgggugaacaacuucuuuucuucagguccacuaugcccggaugcagcggguaccccaacauggauuuggauugccuacucccccaggagugggugcagcacuucuaccaagaggcagcuccagcacaaucugauguggcuuuguugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5582 - RNA, 1623 nt, Artificial Sequence
  VP1__Norovirus__BAJ13885
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuucguacaagccccugguggagaguucacaguauccccuagaaacgcuccaggugaaauacuguggagcgcgcccuuagguccugauuugaaucccuaccuuucccauuuggccagaauguacaaugguuaugcaggugguuuugaagugcaggugauccucgcggggaacgcguucaccgccggaaagaucauauuugcagcagucccaccaaauuucccaacugaagguuugagccccagccaggucacuauguucccccacauaauaguagauguuaggcaauuggaaccuguguugaucccccuacccgauguuaggaauaauuucuaucacuacaaccaaucaaaugaccccaccaucaaauugauagcaauguuguauacaccacuuagggccaauaaugcuggggacgaugucuucacaguuucuugucggguucucacgagaccaucccccgauuuugauuucauauuuuuaguaccacccacaguugagucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgacugauggcgugcuccuagguaccacccaacugucuccugucaacaucugcaccuucagaggggaugucacccauauuacagguagucguaacuacacaaugaauuuggccacucaaaauuggaacaguuaugacccaacagaagaaaucccagccccucuaggaacuccagauuucguggggaagauucaaggugugcucacccaaaccacaagggcagauggcucgacccgcggccacaaagcuacaguguacacugggagcgccgauuuugcuccaaaacuggguagaguucaauuugcuacugacacagacaaugauuuugaugcuaaccaaaacacaaaguucaccccagucggugucauccaggaugguaauacugcccaccgaaaugaaccccaacaaugggugcucccaaguuacucaggcagaaauagucacaaugugcaccuggcccccgcuguagcccccacuuuuccgggugagcaacuucucuucuucagauccacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugauuugguuauuccccccaaugguuauuuuagauuugauuccugggucaaccaguucuacacacuugcccccaugggaaauggaacggggcguagacgugcauuauaa

SEQ ID NO: 5583 - RNA, 1623 nt, Artificial Sequence
  VP1__Norovirus__BAJ13891
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccacauaauaguagauguuaggcaauuggaaccuguguugauccccuuacccgauguuaggaauaauuucuaucacuacaaucaaucaaaugaccccaccaucaaauugauagcaauguuguauacaccacuuagggcuaauaaugcuggggacgaugucuucacaguuucuugucggguucucacgagaccaucccccgauuuugauuucauauuuuuagugccacccacaguugcgucaagaacuaaaccauucucugucccgucaguuacuguugaggagaugaccaauucaagauuccccauuccuuuggaaaagcuguucacgggucccagcagugccuuuguuguucaaccacaaaacggcaggugcacgacugauggcgugcuccuagguaccacccaacugucuccugucaacaucugcaccuucagaggggaugucacccauauuacagguagucguaacuacacaaugaauuuggcuacucaaaauuggaacaguuaugacccaacagaagaaaucccggccccucuaggaacuccagauuucguggggaagauucaaggugugcucacccaaaccacaagggcagauggcucgacccgcggccacaaagcuacaguguacacugggagcgccgauuuugcuccaaaacuggguagaguucaauuugccacugacacagacaaugauuuugaugcuaaccaaaacacaaaguucaccccagucggugucauccaggauggugauacugcccaccgaaaugaaccucaacaaugggugcucccaaguuacucaggcagaaauagucacaaugugcaccuggcccccacuguagcccccacuuuuccgggugagcaacuucucuucuucagauccacuaugcccggaugcagcggguaccccaacauggauuuggacugucugcucccccaggaaugggugcaguauuucuaucaagaggcagccccagcacaaucugauguggcucugcugagauuugugaauccagacacagguaggguuuuguuugaguguaagcuucauaaaucaggcuauguuacaguggcucacaccggccaacaugauuugguuaucccccccaaugguuauuuuagauuugauuccugggucaaccaguucuacacacuugcccccaugggaaauggaacggggcguagacgugcauuauaa

SEQ ID NO: 5584 - RNA, 1623 nt, Artificial Sequence
  VP1__Norovirus__BAJ13894
augaagauggcgucgaaugacgccaacccaucugauggguccacagccaaccucgucccagaggucaacaaugagguaauggcuuuggagcccguuguaggugccgcuauugcggcgccuguagcgggccaacaaaauguaauugaccccuggauuagaaauaauuuuguacaagccccugguggagaguuuacaguguccccccagaaugcucccagugagauacuauggagugcgcccuugggcccugauuugaacccuuaccuuucucaucuggccagaauguauaaugguuaugcaggugguuuugaagugcagguaauccucgcggggaacgcguucaccgccggaaaaaucauauuugcagcagucccaccuaacuuuccaacugaaggcuugagcccuagccagguuacuauguucccccauauaauaguagauguuaggcaauuggaaccuguguugauccccuuaccugauguuaggaauaacuucuaucacuacaaccagucaaaugacccuaccauuaaauugauagcaauguuguacacaccacuuagggccaauaaugcuggggaugaugucuucacagucucuugucgaguccucacgagaccauccccugacuuugacuucauauuucugguaccaccaacaguugaaucaagaaccaaaccauuuaccguuccaaucuuaacuguugaggaaaugaccaauucaagauuccccauuccuuuggaaagguuguacacgggucccagcagugcuuuuguuguccagccacaaaacggcaggugcacgacugauggcgugcucuuagguaccacccagcugucugcugucaacaucugcaccuuuagaggggaugucacucacauugcaggcucucgcaauuauacaaugaauuuggccucucaaaauuggaacaacuaugauccaacagaagaaaucccagccccccugggcaccccagauuucgugggaaagauccaaggcaugcucacccaaaccacaagaagugauggcucgacccgcggccacaaggccacagugcucacugggagugccgacuucgccccaaaauugggcagaguucaauucgccacugacacagacaacgauuucgaaucuggccaaaacacgaaauucaccccaguuggcgucauccaggauggcuccacuacccaccgaaaugaaccucaacaauggguacucccaaauuacucagguagaacuggucauaaugugcaucuagccccugcuguugcccccacuuacccgggugagcaacuccuuuucuucagguccacuaugcccggauguagcggguaccccaacauggaucuagauugcuugcucccccaggagugggugcagcacuucuaccaagaagcagcuccagcacaaucugauguggcucugcuaagauuugugaauccagacacagguaggguucucuuugagugcaagcuccauaaaucaggauaugucacaguggcucacacuggucagcaugauuugguuauuccccccaaugguuauuuuagauuugauuccuggguuaaucaauucuacacacuugcccccaugggaaaugggacggggcguagacgugcuguauaa

SEQ ID NO: 5585 - RNA, 1623 nt, Artificial Sequence
  VP1__Norovirus__BAJ13897
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccacauaauaguagauguuaggcaauuggaaccuguguugauccccuuacccgauguuaggaauaauuucuaucacuacaaucaaucaaaugaccccaccaucaaauugauagcaauguuguauacaccacuuagggcuaauaaugcuggggacgaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgacugauggcgugcuccuagguaccacccaacugucuccugucaacaucugcaccuucagaggggaugucacccauauuacagguagucguaacuacacaaugaauuuggcuacucaaaauuggaacaguuaugacccaacagaagaaaucccggccccucuaggaacuccagauuucguggggaagauucaaggugugcucacccaaaccacaagggcagauggcucgacccgcggccacaaagcuacaguguacacugggagcgccgauuuugcuccaaaacuggguagaguucaauuugccacugacacagacaaugauuuugaugcuaaccaaaacacaaaguucaccccagucggugucauccaggauggugauacugcccaccgaaaugaaccucaacaaugggugcucccaaguuacucaggcagaaauagucacaaugugcaccuggcccccacuguagcccccacuuuuccgggugagcaacuucucuucuucagauccacuaugcccggaugcagcggguaccccaauauggauuuggacugucugcucccccaggaaugggugcaguauuucuaucaagaggcagccccagcacaaucugauguggcucugcugagauuugugaauccagacacagguaggguuuuguuugaguguaagcuucauaaaucaggcuauguuacaguggcucacaccggccaacaugauuugguuaucccccccaaugguuauuuuagauuugauuccugggucaaccaguucuacacacuugcccccaugggaaauggaacggggcguagacgugcauuauaa

SEQ ID NO: 5586 - RNA, 1623 nt, Artificial Sequence
  VP1__Norovirus__BAJ13900
augaagauggcgucgaaugacgccaacccaucugauggguccacagccaaccucgucccagaggucaacaaugagguaauggcuuuggagcccguuguaggugccgcuauugcggcgccuguagcgggccaacaaaauguaauugaccccuggauuagaaauaauuuuguacaagccccugguggagaguuuacagugucccccagaaaugcuccaggugagauacuauggagugcgcccuugggcccugauuugaacccuuaccuuucucaucuggccagaauguauaaugguuaugcaggugguuuugaagugcagguaauccucgcggggaacgcguucaccgccggaaaaaucauauuugcagcagucccaccuaacuuuccaacugaaggcuugagcccuagccagguuacuauguucccccauauaauaguagauguuaggcaauuggaaccuguguugauccccuuaccugauguuaggaauaacuucuaucacuacaaccagucaaaugacccuaccauuaaauugauagcaauguuguacacaccacuuagggccaauaaugcuggggaugaugucuucacagucucuugucgaguccucacgagaccauccccugacuuugacuucauauuucugguaccaccaacaguugaaucaagaaccaaaccauuuaccguuccaaucuuaacuguugaggaaaugaccaauucaagauuccccauuccuuuggaaagguuguacacgggucccagcagugcuuuuguuguccagccacaaaacggcaggugcacgacugauggcgugcucuuagguaccacccagcugucugcugucaacaucugcaccuuuagaggggaugucacucacauugcaggcucucgcaauuauacaaugaauuuggccucucaaaauuggaacaacuaugauccaacagaagaaaucccagccccccugggcaccccagauuucgugggaaagauccaaggcaugcucacccaaaccacaagaagugauggcucgacccgcggccacaaggccacagugcucacugggagugccgacuucgccccaaaauugggcagaguucaauucgccacugacacagacaacgauuucgaaucuggccaaaacacgaaauucaccccaguuggcgucauccaggauggcuccacuacccaccgaaaugaaccucaacaauggguacucccaaauuacucagguagaacuggucauaaugugcaucuagccccugcuguugcccccacuuacccgggugagcaacuccuuuucuucagguccacuaugcccggauguagcggguaccccaacauggaucuagauugcuugcucccccaggagugggugcagcacuucuaccaagaagcagcuccagcacaaucugauguggcucugcuaagauuugugaauccagacacagguaggguucucuuugagugcaagcuccauaaaucaggauaugucacaguggcucacacuggucagcaugauuugguuauuccccccaaugguuauuuuagauuugauuccuggguuaaucaauucuacacacuugcccccaugggaaaugggacggggcguagacgugcuguauaa

SEQ ID NO: 5587 - RNA, 1623 nt, Artificial Sequence
  VP1__Norovirus__BAJ13903
augaagauggcgucgaaugacgccaacccaucugauggguccgcagccaaccucgucccagaggucaacaaugagguuauggcuuuggagcccguugucggugccgcuauugcggcgccuguggcgggccaacaaaauguaauugaccccuggauuagaaauaauuuuguacaagccccugguggagaguucacaguauccccuagaaacgcuccaggcgagauauuguggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccagguuacuauguucccccacauaauaguagauguuaggcaauuggaaccuguguugauccccuuaccugauguuaggaauaauuucuaucauuauaaucagucaaaugauucuaccauuaaauugauagcaaugcuguauacaccacuuagggcuaauaaugcuggggaagaugucuucacagucucuugucgaguccucacgaggccaucccccgauuuugauuuuauauuuuuggugccaccuacaguugagucaagaacuaaaccauuuacugucccaaucuuaacuguugaagaaaugacuaauucaagauuccccauuccuuuggaaaaguuguucacgggucccagcggugccuuuguuguucaaccacaaaauggcagaugcacgacugauggcgugcuccuaggcaccacccaacugucuccugucaacaucugcaccuucagaggggaugucacccacauugcagguucucguaacuacacaaugaauuuggcugcucuaaauuggaacaauuaugacccaacagaagaaauuccagccccucuaggaaccccagauuucgugggaaagauccaaggugugcucacucaaaccacaaagggagauggcucgacccguggccauaaagcuacaguuuacacugggagugccgacuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccaccuuuccgggugaacaacuucuuuucuucagguccacuaugcccggaugcagcggguaucccaacauggauuuggauugccuacucccccaagagugggugcagcacuucuaccaagaggcagcuccagcacaaucugauguggcucuauugagauuugugaauccagacacggguaggguccuguuugagugcaaacuccauaaaucagguuaugucacaguggcucacaccggccagcaugacuuggucaucccccccaauggcuauuuuagguuugauuccuggguuaaucaauucuacacacuugcccccaugggaaauggaacggggcguagacgugcuuuauaa

SEQ ID NO: 5588 - RNA, 1623 nt, Artificial Sequence
  VP1__Norovirus__BAJ13906
augaagauggcgucgaaugacgccaacccaucugauggguccacagccaaccucgucccagaggucaacaaugagguaauggcuuuggagcccguuguaggugccgcuauugcggcgccuguagcgggccaacaaaauguaauugaccccuggauuagaaauaauuuuguacaagccccugguggagaguuuacagugucccccagaaaugcuccaggugagauacuauggagugcgcccuugggcccugauuugaacccuuaccuuucucaucuggccagaauguauaaugguuaugcaggugguuuugaagugcagguaauccucgcggggaacgcguucaccgccggaaaaaucauauuugcagcaguuccaccuaacuuuccaacugaaggcuugagcccuagccagguuacuauguucccccauauaauaguagauguuaggcaauuggaaccuguguugauccccuuaccugauguuaggaauaacuucuaucacuacaaccagucaaaugacccuaccauuaaauugauagcaauguuguacacaccacuuagggcuaauaaugcuggggaugaugucuucacagucucuugucgaguccucacgagaccauccccugacuuugacuucauauuucugguaccaccaacaguugaaucaagaaccaaaccauuuaccguuccaaucuuaacuguugaggaaaugaccaauucaagauuccccauuccuuuggaaagguuguacacgggucccagcagugcuuuuguuguccagccacaaaacggcaggugcacgacugauggcgugcucuuagguaccacccagcugucugcugucaacaucugcaccuuuagaggggaugucacucacauugcaggcucucgcaauuauacaaugaauuuggccucucaaaauuggaacaacuaugauccaacagaagaaaucccagccccccugggcaccccagauuucgugggaaagauccaaggcaugcucacccaaaccacaagaagugauggcucgacccgcggccacaaggccacagugcucacugggagugccgacuucgccccaaaauugggcagaguucaauucgccacugacacagacaacgauuucgaaucuggccaaaacacgaaauucaccccaguuggcgucauccaggauggcuccacuacccaccgaaaugaaccucaacaauggguacucccaaauuacucagguagaacuggucauaaugugcaucuagccccugcuguugcccccacuuacccgggugagcaacuccuuuucuucagguccacuaugcccggauguagcggguaccccaacauggaucuagauugcuugcucccccaggagugggugcagcacuucuaccaagaagcagcuccagcacaaucugauguggcucugcuaagauuugugaauccagacacagguaggguucucuuugagugcaagcuccauaaaucaggauaugucacaguggcucacacuggucagcaugauuugguuauuccccccaaugguuauuuuagauuugauuccuggguuaaucaauucuacacacuugcccccaugggaaaugggacggggcguagacgugcuguauaa

SEQ ID NO: 5589 - RNA, 1623 nt, Artificial Sequence
  VP1__Norovirus__BAJ13909
augaagauggcgucgaaugacgccaacccaucugauggguccgcagccaaccucgucccagaggucaacaaugagguuauggcuuuggagcccguugucggugccgcuauugcggcaccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccuugcggggaacgcguucaccgccggaaaaaucauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguauacaccacuuagggccaauaaugccggggaugaugucuucacagucucuugucgaguccucacgaggccauccccugauuuugacuucauauuuuuggugccaccuacaguugagucaagaacuaagccauuuacugucccaaucuugacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauuacggguucucguaauuacacaaugaauuuggccucucuaaauuggaacaauuacgacccaacagaagaaaucccagccccucugggaacuccagauuucgugggaaagauccaaggugugcucacucaaaccacaaagggagauggcucgacccggggccauaaagcuacaguuuacacugggagugccgacuuuacuccaaagcugggcaguguucaauuugcuacugauacagaaaaugauuuugaaacucaccaaaacacaaaauucaccccagucggugucauccaggaugguggcaccacccaccgaaaugaaccccaacaaugggugcucccaaguuauucagguagaaauguccauaauguacaccuagccccugcuguagcccccaauuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguagggucuuguuugagugcaaacuucauaaaucaggcuaugucacaguggcucacaccggccaacaugauuuggucaucccccccaaugguuauuuuagguuugacuccuggguuaaucaauucuauacacuugcccccaugggaaauggaacggggcguagacgugcuuuauaa

SEQ ID NO: 5590 - RNA, 1623 nt, Artificial Sequence
  VP1__Norovirus__BAJ13912
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcaguuccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucccuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5591 - RNA, 1623 nt, Artificial Sequence
  VP1__Norovirus__BAJ13918
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuugugcaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauucgcagcagucccaccaaacuuuccaacugaaggcuugagucccagccaggucacuauguucccccacauaauaguagauguuaggcaauuagaaccuguguugaucccuuuaccugauguuaggaauaacuucuaucacuacaaucagucaaaugauucuaccauuaaauugauagcaaugcuguauacaccacuuagggccaauaaugcuggggaugaugucuucacagucucuugucgaguccucacgagaccauccccugauuuugauuuuauauuuuuggugccaccuacaguugagucaagaaccaagccauucacugucccaaucuuaacuguugaagaaaugaccaauucaagauuccccauuccuuuggaaaaacuguucacgggucccagcagugccuuuguuguucaaccacaaaauggcagaugcacuacugauggcgugcucuuaggcaccacccaacugucuccugucaacaucugcaccuucagaggagaugucacccacauugcggguucccgcaauuacacaaugaauuuggccucucuaaauuggaacaauuaugacccaacagaagaaauuccagccccccugggaacuccagauuuugugggaaagauccaaggugugcucacucaaaccacaaagggagauggcucgacccggggccauaaagcuacaguuuacacugggagugccgacuuuacuccaaagcugggcagcguucaauuugguacugauacagaaaaugauuuugaaacucaccaaaacacaaaauucaccccagucggugucauccaggaugguagcaccacccaccgaaaugaaccccaacaaugggugcucccaagcuauucagguagaaauguccauaauguacaccuagccccugcuguagcucccaauuucccgggugaacaacuucuuuucuucagguccacuaugcccggaugcagcggguaucccaacauggauuuggauugccugcucccccaggagugggugcagcacuucuaccaagaggcagcuccagcacaaucugauguggcucuauugagauuugugaauccagacacggguaggguccuguuugagugcaaacuucacaaaucaggcuaugucacaguggcucacaccggccaacaugauuuggucaucccccccaauggcuauuuuagguuugauuccuggguuaaccaauucuacacacuugcccccaugggaaauggaacggggcguagacgugcuuuauaa

SEQ ID NO: 5592 - RNA, 1623 nt, Artificial Sequence
  VP1__Norovirus__BAJ13924
augaagauggcgucgaaugacgccagcccaucugauggguccgcagccaaccucgucccagaggucaacaaugagguuauggcuuuggagcccguugucggugccgcuauugcggcgccuguagcgggccaacaaaauguaauugaccccuggauuagaaacaauuuuguacaagccccugguggagaguucacaguguccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacugucucuugucgaguucucacgaggccauccccugauuuugauuuuauauuuuuggugccaccuacaguugagucaagaacuaaaccauuuacugucccaaucuuaacuguugaagaaaugaccaacucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaacuacacaaugaauuuggccucucuaaauuggaacaauuaugacccaacagaagaaauuccagccccucuaggaacuccagauuucgugggaaagauccaaggugugcucacccaaaccacaaagggagauggcucgacccguggccauaaagcuacaguuuauacugggagugcccccuuuacuccaaagcugggcaguguucaauucaguacugauacagaaaaugauuuugaaacucaccaaaacacaaaauucaccccagucggcgucauccaggaugguggcaccacccaccgaaaugaaccccaacaaugggugcucccaaguuauucagguagaaauguccagaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacgcuugcccccaugggaaauggaacggggcguagacgugcuuuauaa

SEQ ID NO: 5593 - RNA, 1623 nt, Artificial Sequence
  VP1__Norovirus__BAJ13927
augaagauggcgucgaaugacgccaacccaucugauggguccgcagccaaccucgucccagaggucaacaaugagguuauggcuuuggagcccguugucggugccgcuauugcggcgccuguagcgggccaaacaaacguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugagucccagccaggucacuauguucccccacauaauaguagauguuagacaauuggaaccuguguugauccccuuaccugacguuaggaauaauuucuaucacuauaaucagucaaaugauuccaccauuaaacugauagcaaugcuguauacaccacuuagggccaauaacgcuggggaagaugucuucacagucucuugucgaguccucacgaggccauccccugauuuugauuuuauauuuuuggugccacccacaguugagucaagaacuaaaccauuuacugucccaaucuuaacuguugaagagaugaccaauucaagauuccccaucccuuuggaaaaguuguucacgggucccagcggugccuuugucguucaaccacaaaauggcaggugcacgacugauggcgugcucuuaggcaccacccaacugucuccugucaacaucugcaccuucagaggggaugucacccacauugcagguucucguaauuauacaaugaauuuggcuucccuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggggugcccccuuuacuccaaagcugggcagcgcucaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguucauaauguacaccuagccccugcuguggcccccacuuuuccgggugaacaacuucuuuucuucagguccacuaugcccggaugcagcggguaucccaacauggauuuggauugccuacucccucaggagugggugcagcacuucuaccaagaggcagcuccagcacaaucugauguggcuuuauugagauuugugaauccagacacggguaggguccuguuugagugcaaacuucauaaaucaggcuaugucacaguggcucacaccggccagcaugauuuggucaucccccccaauggcuauuuuagguucgauuccuggguuaaucaauucuacacacuugcccccaugggaaauggaacggggcguagacgugcuuuauaa

SEQ ID NO: 5594 - RNA, 1623 nt, Artificial Sequence
  VP1__Norovirus__BAJ13930
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuagacccugaucugaaucccuaccuaucucaauuggccagaauguauaaugguuaugcaggugguuuugaagugcaggugauccucgcggggaacgcguucaccgccgggaaaauuauauuugcagcagucccaccaaauuuuccaacugaaggcuugagucccagccaggucacuauguucccccacauaauaguggauguuaggcaauuggaaccuguguugaucccccuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggccucucuaaauuggaacaauuaugacccaacagaagaaauuccagccccucuaggaacuccagauuuugugggaaagauccaaggugugcucacucaaaccacaaagggagauggcucgacccguggccauaaagcuacaguuuacacugggagugcccccuuuacuccaaagcugggcaguguccaauucaguacugauacagagaaugauuuugaaacucaccaaaacacaaaguucaccccagucggugucauccaggaugguggcaccacccaucgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccuacucccccaggagugggugcagcacuucuaccaagaagcagcuccggcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauuuuacacacuugcccccaugggaaauggaacggggcguagacgugcuuuauaa

SEQ ID NO: 5595 - RNA, 1623 nt, Artificial Sequence
  VP1__Norovirus__BAJ13933
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguaucaccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuuuagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacucaccgaaaugaaccccaacaaugggugcucccaaguuauucagguagaaauguccauaaugugcaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcgcaaucugauguggcucuacugagauuugugaauccagacacggguaggguccuguuugaguguaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5596 - RNA, 1623 nt, Artificial Sequence
  VP1__Norovirus__BAJ13936
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucccuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5597 - RNA, 1623 nt, Artificial Sequence; identical to SEQ ID NO: 5567
  VP1__Norovirus__BAJ13939

SEQ ID NO: 5598 - RNA, 1623 nt, Artificial Sequence
  VP1__Norovirus__BAJ13942
augaagauggcgucgaaugacgccaacccaucugauggguccgcagccaaccucgucccagaggucaacaaugagguuauggcuuuggagcccguugucggugccgcuauugcggcgccuguagcgggccaaacaaacguaauugaccccuggauuagaaauaauuuuguacaagccccugguggagaguucacagugucccccagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugagucccagccaggucacuauguucccccacauaauaguagauguuagacaauuggaaccuguguugauccccuuaccugacguuaggaauaauuucuaucacuauaaucagucaaaugauuccaccauuaaacugauagcaaugcuguauacaccacuuagggccaauaacgcuggggaagaugucuucacagucucuugucgaguccucacgaggccauccccugauuuugauuuuauauuuuuggugccacccacaguugagucaagaacuaaaccauuuacugucccaaucuuaacuguugaagagaugaccaauucaagauuccccaucccuuuggaaaaguuguucacgggucccagcggugccuuugucguucaaccacaaaauggcaggugcacgacugauggcgugcucuuaggcaccacccaacugucuccugucaacaucugcaccuucagaggggaugucacccacauugcagguucucgugauuauacaaugaauuuggcuucccuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcagcguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguucauaauguacaccuagccccugcuguggcccccacuuuuccgggugaacaacuucuuuucuucagguccacuaugcccggaugcagcggguaucccaacauggauuuggauugccuacucccucaggagugggugcaacacuucuaccaagaggcagcuccagcacaaucugauguggcuuuauugagauuugugaauccagacacggguaggguccuguuugagugcaaacuucauaaaucaggcuaugucacaguggcucacaccggccagcacgauuuggucaucccccccaauggcuauuuuagguucgauuccuggguuaaucaauucuacacacuugcccccaugggaaauggaacggggcguagacgugcuuuauaa

SEQ ID NO: 5599 - RNA, 1623 nt, Artificial Sequence; identical to SEQ ID NO: 5557
  VP1__Norovirus__BAJ13945

SEQ ID NO: 5600 - RNA, 1623 nt, Artificial Sequence
  VP1__Norovirus__BAJ13948
augaagauggcgucgaaugacgccaacccaucugauggguccgcagccaaccucgucccagaggucaacaaugagguuauggcuuuggagcccguugucggugccgcuauugcggcgccuguagcgggccaacaaaaugugauugaccccuggauuagaaauaauuuuguacaagccccugguggagaguucacaguauccccuagaaacgcuccaggugaaauacuauggagcgcgcccuuaggcccugaucugaaucccuaccuaucccauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaauuucuaccacuauaaucagucaaaugauucuaccauuaaauugauagcaaugcuguauacaccacuuagggcuaauaaugcuggggaggaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguuuacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagacgguucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguaacaccacccaccggaaugaaccccaacaaugggugcucccaaguuauucagguagaaauguccaaaauguacaccuagccccugcuguagcccccacuuuuccgggugaacaacuucuuuucuuuagguccacuaugcccggauguagcggguaccccaacauggauuuggauugccuacucccccaggagugggugcagcacuucuaccaagaggcagcuccagcacaaucugauguggcucuauugagauuugugaauccagacacggguaggguccuguuugagugcaagcuucauaaaucaggcuaugucacaguggcucacaccggccagcaugauuuggucaucccccccaaugguuauuuuagguuugauuccuggguuaaucaauucuacacacuugcccccaugggaaaugggacggggcguagacgugcuuuauaa

SEQ ID NO: 5601 - RNA, 1623 nt, Artificial Sequence
  VP1__Norovirus__BAJ13951
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaauccuuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuagacaauuggaaccuguguugauccccuuaccugauguuaggaauaacuucuaucacuauaaucagucaaaugauucuaccauuaaauugauagcaauguuguauacaccacuuagggcuaauaaugcuggggaagaugucuuuacagucucuugucgaguucucacgaggccauccccugauuuugauuucauauuuuuagugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaauaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaguucaguacugauacagaaaaugauuuugaaacucaccaaaacacaaaauucaccccagucggugucauccaggaugguagcaccacccaccgaaaugaaccccaacaauggguacucccaaguuauucagguagaaauguccauaauguacaccuagccccugcuguagcccccacuuuuccgggugaacaacuucuuuucuuuagguccacuaugccuggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuccauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5602 - RNA, 1623 nt, Artificial Sequence
  VP1__Norovirus__BAJ13954
augaagauggcgucgaaugacgccaacccaucugauggguccgcagccaaccucgucccagaggucaacaaugagguuauggcuuuggagcccguugucggugccgcuauugcggcgccuguagcgggccaacaaaaugugauugaccccuggauuagaaauaauuuuguacaagccccugguggagaguucacaguauccccuagaaacgcuccaggugaaauacuauggagcgcgcccuuaggcccugaucugaaucccuaccuaucccauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaauuucuaccacuauaaucagucaaaugauucuaccauuaaauugauagcaaugcuguauacaccacuuagggcuaauaaugcuggggaggaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguuuacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaagguaugcucacucaaaccacaaagggagacgguucgacccguggucauaaagcuacaguuuacacugggagugcccccuuuacuccaaagcugggcaguguucaauucaguacugauacagaaaaugauuuugaaacucaccaaaacacaaaauucaccccagucggugucauccaggaugguaacaccacccaccggaaugaaccccaacaaugggugcucccaaguuauucagguagaaauguccaaaauguacaccuagccccugcuguagcccccacuuuuccgggugaacaacuucuuuucuuuagguccacuaugcccggaugcagcggguaccccaacauggauuuggauugccuacucccccaggagugggugcagcacuucuaccaagaggcagcuccagcacaaucugauguggcucuauugagauuugugaauccagacacggguaggguccuguuugagugcaagcuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5603 - RNA, 1623 nt, Artificial Sequence
  VP1__Norovirus__BAJ13957
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgccuucaggcccugaucugaaucccuaccuaucucauuuggccagaauguuuaaugauuaugcaggugguuuugaagugcaggugauccucgcggggaacgcguucaccgccggaaaaauuauauuugcagcagucccaccaaauuuuccaacugaaggcuugagucccagccaggucacuauguucccccauauaauaguagauguuaggcaauuggaacccguguugauccccuuaccugauguuaggaauaacuucuaucauuauaaucagucaaaugauucuaccauuaaacugauagcaaugcuguauacaccacuuagggccaauaaugcuggggaagaugucuucacagucucuugucggguccucacgaggccguccccugauuuugauuuuauauuuuuggugccacccacaguugagucaagaacuaaaccauuuacugucccaauuuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaacuaugacccaacagaagaaauuccagccccucuaggaacuccagauuucgugggaaagauccaaggugugcucacucaaaccacaaagggagauggcucgacccguggucauaaagcuacaguuuacacugggagugcccccuuuacuccaaagcugggcaguguucaauucaguacugauacagaaaaugauuuugaagcucaccaaaacacaaaauucaccccagucggugucauccaggaugguagcaccacccaccgaaaugaaccccaacaaugggugcucccaaguuauucagguagaaauguucaaaauguacaccuagccccugcuguagcccccacuuuuccgggugaacaacuccuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcccacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5604 - RNA, 1623 nt, Artificial Sequence
  VP1__Norovirus__BAJ13960
augaagauggcgucgaaugacgccaacccaucugauggguccgcagccaaccucgucccagaggucaauaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaauuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccaguagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaauaauuaugacccaacagaagaaauuccagccccucuaggaacuccagauuucgugggaaagauccaaggugugcucacucaaaccacaaagggagauggcucgacccguggccauaaagcuacaguuuauacugggagugcccccuuuacuccaaagcugggcaguguccaauucaguacugauacagaaaaugauuuugaaacucaucaaaacacaaaauucaccccagucggugucauccaggaugguggcaccacccaccgaaaugaaccccaacaaugggugcucccaaguuauucagguagaaaugucccuaauguacacuuagccccugcuguagcccccacuuuuccgggugaacaacuucucuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacgggaaggguccuguuugagugcaaacuccauaaaucaggcuaugucacaguggcucacaccggccagcaugauuugguuaucccccccaauggcuauuuuagguuugauuccuggguuaaucaauucuacacacuugcccccaugggaaauggaacggggcguagacgugcuuuauaa

SEQ ID NO: 5605 - RNA, 1623 nt, Artificial Sequence
  VP1__Norovirus__BAJ13963
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauuccaccauuaaauugauagcaauguuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaaccccagauuucgugggaaagauccaaggagugcucacccaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccugcucccccaggagugggugcagcacuucuaccaagaggcagcuccagcacaaucugauguggcucuauugagauuugugaauccagacacggguaggguccuguuugagugcaagcuucacaaaucaggcuaugucacaguggcucacaccggccagcaugauuuggucaucccccccaaugguuauuuuagguuugauuccuggguuaaucaguucuacacacuugcccccaugggaaauggaacggggcguagacgugcuuuauaa

SEQ ID NO: 5606 - RNA, 1623 nt, Artificial Sequence; identical to SEQ ID NO: 5591
  VP1__Norovirus__BAJ13966

SEQ ID NO: 5607 - RNA, 1623 nt, Artificial Sequence
  VP1__Norovirus__BAJ13969
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuucacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5608 - RNA, 1623 nt, Artificial Sequence
  VP1__Norovirus__BAJ13972
augaagauggcgucgaaugacgccaacccaucugauggguccgcagccaaccucgucccagaggucaacaaugagguuauggcuuuggagcccguugucggugccgcuauugcggcgccuguggcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauuccaccauuaaauugauagcaaugcuguauacaccacucagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugcuuuuguuguucaaccacaaaauggcagaugcacgacugauggcgugcucuuaggcaccacccaacugucuccugucaacaucugcaccuucagaggggaugucacccacauugcagguucucgugauuacacaaugaauuuggcuucucuaaauuggaacaauuaugacccaacagaagaaauuccagccccucuaggaacuccagauuuugugggaaagauccaaggugugcucacucaaaccacaaagggagauggcucgacccguggccauaaagcuacaguuuacacugggaguguccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuccauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5609 - RNA, 1623 nt, Artificial Sequence
  VP1__Norovirus__BAJ13975
augaagauggcgucgaaugacgccaacccaucugauggguccgcagccaaccucgucccagaggucaacaaugagguuauggcuuuggagcccguugucggugccgcuauugcggcaccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccuugcggggaacgcguucaccgccggaaaaaucauauuugcagcagucccaccaaauuuuccaacugaaggcuugagucccagccaggucacuauguucccccacauaauaguagauguuaggcaauuggaaccuguguugauccccuuaccugauguuaggaacaacuucuaucacuauaaucagucaaaugauucuaccauuaaauugauagcaaugcuguauacaccacuuagggccaauaaugccggggaugaugucuucacagucucuugucgaguccucacgaggccauccccugauuuugacuucauauuuuuggugccaccuacaguugagucaagaacuaagccauuuacugucccaaucuugacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcggguucucguaauuacacaaugaauuuggccucucuaaauuggaacaauuacgacccaacagaagaaaucccagccccucugggaacuccagauuuugugggaaagauccaaggugugcucacucaaaccacaaagggagauggcucgacccggggccauaaagcuacaguuuacacugggagugccgacuuuacuccaaagcugggcaguguucaauuugcuacugauacagaaaaugauuuugaaacucaccaaaacacaaaauucaccccagucggugucauccaggaugguggcaccacccaccgaaaugaaccccaacaaugggugcucccaaguuauucagguagaaauguccauaauguacaccuagccccugcuguagcccccaauuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguagggucuuguuugagugcaaacuucauaaaucaggcuaugucacaguggcucacaccggccaacaugauuuggucaucccccccaaugguuauuuuagguuugacuccuggguuaaucaauucuauacacuugcccccaugggaaauggaacggggcguagacgugcuuuauaa

SEQ ID NO: 5610 - RNA, 1623 nt, Artificial Sequence
  VP1__Norovirus__BAJ13978
augaagauggcgucgaaugacgccaacccaucugauggguccgcagccaaccucgucccagaggucaacaaugagguuauggcuuuggagcccguugucggugcugcuauugcggcgccuguagcgggccaacaaaauguaauugaccccuggauuagaaauaauuuuguacaagccccugguggagaguucacaguauccccuaggaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggagcccguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauucccuauuccuuuggaaaaguuguucacgggucccagcggugccuuuguuguucaaccacaaaauggcagaugcacgacugauggcgugcucuuagguaccacccaacugucuccugucaacaucugcaccuucagaggggaugucacccacauugcagguucucguaauuacacaaugaauuuggcuucucuaaauuggaauaauuaugacccaacagaagaaauuccagccccucuaggaacuccagauuucgugggaaagauccaaggugugcucacucaaaccacaaagggagauggcucgacccguggccauaaagcuacaguuuacacugggaguacccccuuuacuccaaagcugggcaguguucaauucaguacugauacagaaaaugauuuugaaacucaccaaaacacaaaauuuaccccagucggugucauccaggaugguagcaccauccaccgaaaugaaccccaacaaugggugcucccaaguuauucagguagaaauguccaaaauguacaccuagccccugcuguagcccccacuuuuccgggugaacaacuucuuuucuucagguccacuaugcccggaugcagcggguauccuaacauggauuuggauugccuacucccccaggagugggugcagcacuucuaccaagaggcagcuccagcacaaucugauguggcucuacugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuauacacuugcccccaugggaaauggaacggggcguagacgugcuuuauaa

SEQ ID NO: 5611 - RNA, 1623 nt, Artificial Sequence
  VP1__Norovirus__BAJ13981
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaauguuguauacaccacuuagggcuaauaaugcuggggaagaugucuuuacagucucuugucgaguucucacgaggccauccccugauuuugauuuuauauuuuugguaccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaaccccagauuucgugggaaagauccaaggagugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccaguuggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccugcucccccaggagugggugcagcacuucuaccaagaggcagcuccagcacaaucugauguggcgcuauugagauuugugaauccagacacggguaggguccuguuugagugcaagcuucacaaaucaggcuaugucacaguggcucacaccggccagcaugaucuggucaucccccccaaugguuauuuuagguuugauuccuggguuaaucaguucuacacacuugcccccaugggaaauggaacggggcguagacgugcuuuauaa

SEQ ID NO: 5612 - RNA, 1623 nt, Artificial Sequence
  VP1__Norovirus__BAJ13984
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguauacaccacuuagggccaauaaugcuggggaggaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucccuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucagacguggcuuuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5613 - RNA, 1623 nt, Artificial Sequence; identical to SEQ ID NO: 5612
  VP1__Norovirus__BAJ13987

SEQ ID NO: 5614 - RNA, 1623 nt, Artificial Sequence
  VP1__Norovirus__BAJ13990
augaagauggcgucgaaugacgccagcccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaauguuguauacaccacuuagggcuaauaaugcuggggaagaugucuuuacagucucuugucgaguucucacgaggccauccccugauuuugauuuuauauuuuugguaccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaaccccagauuucgugggaaagauccaaggagugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccaguuggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccugcucccccaggagugggugcagcacuucuaccaagaggcagcuccagcacaaucugauguggcgcuauugagauuugugaauccagacacggguaggguccuguuugagugcaagcuucacaaaucaggcuaugucacaguggcucacaccggccagcaugaucuggucaucccccccaaugguuauuuuagguuugauuccuggguuaaucaguucuacacacuugcccccaugggaaauggaacggggcguagacgugcuuuauaa

SEQ ID NO: 5615 - RNA, 1623 nt, Artificial Sequence
  VP1__Norovirus__BAJ13993
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaccugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaacugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5616 - RNA, 1623 nt, Artificial Sequence
  VP1__Norovirus__BAJ13996
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucgcaacuacacaaugaacuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucagcacugauacagaaaaugauuuugaaacucaccaaaacacaaaauucaccccagucggugucauccaggaugguggcaccacccaccgaaaugaaccccaacaaugggugcucccaaguuauucagguagaaauguccagaauguacaccuagccccugcuguagcccccacuuuuccgggugaacaacuucuuuucuuuagguccacuaugcccggaugcagcggguaucccaacauggaucuggauugccuacucccccaggagugggugcagcauuucuaccaagaggcagcuccagcacaaucugauguggcucuauugagauucgugaauccagacacggguaggguccuguuugagugcaaacuucauaaaucaggcuaugucacaguggcucacaccggccagcaugauuugguuaucccccccaauggcuauuuuagguuugauuccuggguuaaucaauucuacacacuugcccccaugggaaauggaacggggcguagacgugcuuuauaa

SEQ ID NO: 5617 - RNA, 1623 nt, Artificial Sequence
  VP1__Norovirus__BAJ13999
augaagauggcgucgagugacgccaacccaucugauggguccgcagccaaccucgucccagaggucaacaaugagguuauggcuuuggagcccguugucggugccgcuauugcggcgccuguggcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcaguuccaccaaauuuuccaacugaaggcuugagucccagccaggucacuauguucccccacauaauaguagauguuaggcaauuggaaccuguguuaauccccuuaccugauguuaggaauaauuucuaucacuauaaccagucaaaugauucuaccauuaaauugauagcaaugcuguauacaccacuuagggcuaauaaugcuggggaagaugucuucacagucucuugucgaguccucacgaggccauccccugauuuugauuuuauauucuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaacuacacaaugaauuuggcuucucuaaauuggaacaauuaugacccaacagaagaaauuccagccccucuaggaacuccagauuucgugggaaagauccaagguaugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagagauguccauaauguacaccuagccccugcuguagcccccacuuucccgggugaacaacuucucuucuucagguccacuaugcccggaugcagcggguaucccaacauggauuuggauugccuacucccccaggagugggugcagcacuucuaccaagaggcggcuccagcucaaucugauguggcucuauugagauuugugaauccagacacggguaggguccuguuugagugcaaacuucauaaaucaggcuaugucacaguggcucacaccggccagcaugauuuggucaucccccccaauggcuacuuuagguuugauuccuggguuaaucaauucuacacacuugcccccaugggaaauggaacggggcguagacgugcuuuauaa

SEQ ID NO: 5618 - RNA, 1623 nt, Artificial Sequence
  VP1__Norovirus__BAJ14002
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucgcaacuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucagcacugauacagaaaaugauuuugaaacucaccaaaacacaaaauucaccccagucggugucauccaggaugguggcaccacccaccgaaaugaaccccaacaaugggugcucccaaguuauucagguagaaauguccagaauguacaccuagccccugcuguagcccccacuuuuccgggugaacaacuucuuuucuuuagguccacuaugcccggaugcagcggguaucccaacauggaucuggauugccuacucccccaggagugggugcagcauuucuaccaagaggcagcuccagcacaaucugauguggcucuauugagauucgugaauccagacacggguaggguccuguuugagugcaaacuucauaaaucaggcuaugucacaguggcucacaccggccagcaugauuugguuaucccccccaauggcuauuuuagguuugauuccuggguuaaucaauucuacacacuugcccccaugggaaauggaacggggcguagacgugcuuuauaa

SEQ ID NO: 5619 - RNA, 1623 nt, Artificial Sequence
  VP1__Norovirus__BAJ14005
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcugucccaccaaauuuuccaacugaaggcuugagucccagccaggucacuauguucccccacauaauaguggauguuaggcaauuggaaccuguguugauccccuuaccugacguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacuguccucaucuuaacuguugaagaaaugaccaauucaagauuccccauuccuuuggaaaaacuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaauucaccaaaacacaaaauucaccccagucggugucauccaggaugguagcaccacccaccgaaaugaaccccaacaaugggugcucccaaguuauucagguagaaauguccauaauguacaccuagccccugcuguggcucccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcuuacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5620 - RNA, 1623 nt, Artificial Sequence
  VP1__Norovirus__BAJ14008
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccagucuuaacuguugaagaaaugaccaauucaagauuccccauuccuuuggaaaaguuguucacggguccuagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuucacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugaaguggcuuuauugagauuugugaauccagacacggguaggguccuguuugagugcaaacuucauaaaucaggcuaugucacaguggcucacaccggccagcaugauuuggucaucccccccaauggcuauuuuagguuugauuccugggucaaucaauucuacacacuugccccuaugggaaauggaacggggcguagacgugcuuuauaa

SEQ ID NO: 5621 - RNA, 1623 nt, Artificial Sequence
  VP1__Norovirus__BAJ14011
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugacguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaacuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaauucaccaaaacacaaaauucaccccagucggugucauccaggaugguagcaccacccaccgaaaugaaccccaacaaugggugcucccaaguuauucagguagaaauguccauaauguacaccuagccccugcuguggcucccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcuuacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5622 - RNA, 1623 nt, Artificial Sequence
  VP1__Norovirus__BAJ14014
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaccagucaaaugauucuaccauuaaacugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccaguggugcauuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaaugugcaccuagccccugcuguagcccccacuuuuccgggugaacaacuucuuuucuucagguccacuaugcccggaugcagcggguaucccaacauggacuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5623 - RNA, 1623 nt, Artificial Sequence
  VP1__Norovirus__BAK43269
auggcgucgaaugacgccgcuccaucuacugauggugcagccggccucgugccagaaaguaauaaugaggucauggcucuugaacccguggcuggugccgccuuggcagccccggucaccggucaaacaaauauuauagacccuuggauuagagcaaauuuuguccaggcccccaauggugaauuuacagucucuccccguaaugccccuggugaagugcuauugaaucuagaguuggguccagaauuaaauccuuaucuggcacauuuagcaagauuguacaacggguaugccggugggauggaggugcaggucauguuggcugggaacgcguucacagccggcaaguuggucuuccccgcugugccaccucacuucccgauugaaaaccuuagcccacagcaaauuaccauguuuccucaugugauuauagauguaaggacuuuggaacccguuuuauuaccacucccugauguuagaaauaauuucuuccacuauaaucagaaagaugaucccaagaugagaaucguggcuaugcuuuacaccccccuuaggucuaaugguucaggugaugacguauucacggucuccugcaggguguugacuagacccuccccugauuuugauuucacauaccuggugccaccaacaguggagucuaaaacaaaaccauucacccucccaauucucacacuuggggaacuuuccaauucuagauucccaguguccauagaccagauguacaccagccccaaugaagucauaucagugcagugucaaaaugguaggugcacacuggauggggagcuccaaggaacgacccaacuccaggucaguggcauuugugcuuuuaagggagaaguaacugcccacuugcaugacaaugaucaccuauacaacaucaccaucacaaacuugaauggguccccuuuugaucccuccgaggacaucccugccccccugggcguaccugacuuucagggaagagucuuugguaucaucucccaaagagacaagcacaauuccccuggacauaaugaaccagcaaauagaggacacgacgcuguggucccuaccuacacagcacaguacacuccaaaauugggucagauucaaauuggcacauggcagaccgacgaucucacagucagccaaccaguaaaauucaccccaguuggacucaaugauauugaacauuuuaaccaaugggugguuccuagauaugcuggugcucuaaaucuuaauacaaaucuugccccuucuguugcuccaguauuuccaggggagcgccuacucuuuuucagaucauauaucccccucaagggugguuauggaaauccagccauugauugccuacuaccacaagagugggugcaacauuucuaccaggaagcagccccuucaaugagugagguggcccuugucagauacaucaacccggauacuggucgggcacuguucgaggccaagcuccacagagcugguuucaugacaguuucaagcaacaccagugccccggugguugugccugccaacggauacuuuagauuugauucuugggugaaccaauucuauucucucgcccccaugggaacugggaaugggcguagaaggguucaauaa

SEQ ID NO: 5624 - RNA, 1623 nt, Artificial Sequence
  VP1__Norovirus__BAK43272
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaauuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuucauauucuuggugccaccuacaguugagucaagaacuaaaccauuuacugucccaaucuuaacuguugaagaaaugaccaacucaagauuccccauuccuuuggagaaguuguucacaggucccagcagugccuuuguuguucaaccacaaaauggcagaugcacaacugauggcgugcucuuaggcaccacccagcugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuucacuccaaagcugggcaguguucaauucaguacugauacacaaaaugauuuugaaacccaccaaaacacaaaauucaccccagucggugucauccaggaugguggcaccacccaccgaaaugaaccucaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccuacuaccccaggagugggugcagcacuucuaccaagaggcagcuccagcacaaucugauguggcucuauugagauuugugaauccagacacggguaggguccuguuugagugcaaacuucauaaaucacgcuaugucacaguggcucacaccggucagcaugauuuggucaucccccccaaugguuauuuuagguuugacuccuggguuaaucaauucuacacgcuugcccccaugggaaauggaacggggcguagacgugcuuuauaa

SEQ ID NO: 5625 - RNA, 1647 nt, Artificial Sequence
  VP1__Norovirus__BAK43275
augaagauggcgucgaaugacgccgcuccaucuaaugauggugccgccggccucgucccagagaucaacaaugaggcaauggcgcuagaaccaguggcgggugcagcgauagcagcaccccucacuggccagcaaaauauaauugaucccuggauuaugaauaauuuugugcaagcaccugguggugaguuuacagugucuccuaggaauuccccuggugaagugcuucucaauuuggaauugggcccagaaauaaaucccuauuuggcccaucuugcuagaauguauaaugguuaugcagguggguuugaagugcagguaguccuagcuggaaaugcguuuacagcaggaaagauaauuuuugcagcuauacccccuaacuucccaauugacaaucuaagcgcagcacagaucacaaugugcccacaugugauuguggaugucagacaguuggaaccggucaaccuuccgaugccugacguucgcaacaacuucuuccauuacaaccaagggucugauucgagauugcgcuuaguugcaaugcuguauacaccucuuagggcaaauaauucuggggaugauguuuuuacugugucuuguagagugcuaacuaggccuagcccugacuuuucauuuaacuuccuugugccacccacuguggagucaaagacaaaacccuucacccucccuauuuugacuaucucugaaaugucuaauucuagguuuccagugccgauugauucucugcacaccagcccaacugagaauauuguuguccagugccaaaaugggcgcgucacucuugauggugaguugaugggcaccacccaacucuuaccuagucaaaucugugcuuuuaggggcgugcucacaagaucaacaagcagggccagugaccaggccgacacagcaaccccuagauuguuuaauuauuauuggcacauacaauuggcuaaucuaaaugggacuccuuaugauccugcagaagacauaccaggcccccugggaacaccagacuuccggggcaaagucuuuggcguggccugccagagaaaucccgacuguacaacuagagcacaugaagcaaagguggacacaacagcuggucgcuucaccccaaaacuaggcucauuggagauaucuacugaaucuggugacuuugaccaaaaccaaccaacaagauucaccccaguuggcauugggguugaccacgaggcagacuuccaacaaugguccuuacccgauuauucuggucaguucacucacaacaugaacuuagccccagcuguugcucccaauuucccuggugagcagcuccuuuucuuccgcucacaguuaccaucuucuggugggcgauccaaugggauucuagacugccuggucccccaagaauggguucagcacuucuaccaagaaucggcccccgcccaaacccagguggcccugguuagauaugucaacccugacacugguagaguguuguuugaggccaagcugcacaaauuaggcuucaugacuauagcuaagaauggugacucuccaauaacuguccccccaaauggauacuuuagguuugaaucuugggugaacccauuuuauacacuugcccccaugggaacugggaaugggcguagaaggauucaauaa

SEQ ID NO: 5626 - RNA, 1623 nt, Artificial Sequence
  VP1__Norovirus__BAK43278
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaccccuaccuuucccauuuggccagaauguacaaugguuaugcaggugguuuugaagugcagguaauccucgcggggaaugcguucaccgccgggaaaaucauauuugcagcagucccaccaaauuuuccaacugaagguuugagccccagccaggucacuauguucccccacauaauaguagauguuaggcaauuggaaccuguguugauucccuuacccgauguuaggaauaauuucuaccauuauaaucaaucaaaugaccccacuaucaaauuaauagcaauguuguauacaccacucagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuucccauuccuuuggaaaaguuguucacgggcccuaguagugccuuuguuguucaaccacaaaacggcaggugcacgacugauggcgugcuccuagguacuacccaacugucuccugucaacaucugcaccuucagaggggaugucacccauauuucaggcagucguaacuacacaaugaauuuggccucccaaaauuggaacaguuacgauccaacagaagaaaucccagccccuuuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacacucauaaugugcaccuggcccccgcuguagcccccacuuucccgggcgagcagcuccucuuuuucagauccacuaugccuggaugcagcggguaccccaacauggauuuggacugucugcucccccaggaaugggugcaguauuucuaccaggaggcagccccagcacaaucugauguggcucuguuaagauuugugaauccagacacagguaggguuuuguuugaguguaagcuucauaaaucaagcuauguuacaguggcucacacuggccaacaugauuugguuaucccucccaauggcuauuuuagauuugauuccugggucaaccaguucuacacacuugcccccaugggaaaugggacggggcguagacaugcauuauaa

SEQ ID NO: 5627 - RNA, 1623 nt, Artificial Sequence
  VP1__Norovirus__BAK43284
auggcgucgaaugacgccgcuccaucuacugauggugcagccggccucgugccagaaaguaacaaugaggucauggcucuugaacccguggcuggugccgccuuggcagcaccggucaccggucaaacaaauauuauagacccuuggauuagagcaaauuuuguccaggcccccaauggcgaauuuacagucucuccccguaaugccccuggugaagugcuauuaagucuagaauuggguccagaauuaaauccuuaucuggcacauuuagcaagaauguacaacggguaugccggugggauggaggugcaggucauguuggcugggaaugcguucacagccggcaaguuggucuucgccgcugugccaccucacuucccgguugaaaaccuuagcccacagcaaauuaccauguucccucaugugauuauagauguaaggaccuuggaaccuguuuuauuaccacucccugauguuaggaauaauuucuuccauuauaaucagaaagaugaucccaaaaugagaauuguggcuaugcuuuauaccccccuuagaucuaaugguucaggugaugauguguucacaguuuccugcaggguguugaccagacccuccccugauuucgauuucacauaucuggugccaccaacaguggaaucuaaaacaaaaccauucacccucccaauccucacacuuggggaacuuuccaauucuagguucacaguguccauagaccagauguacaccagccuuaaugaaguuauaucagugcagugucaaaaugggaggugcacauuggacggggaacuucgagggacaacacaacuccaagucaguggcauuugugcuuucaagggggaagugaccgcccaugugcaugacaaugaucaccuauacaaugucaccaucacaaacuugaauggguccccuuuugaccccuccgaggacguuccugccccucugggcgugccugauuuccagggaagggucuuugguauuaucucccaaagagacaaacauaauagcccugggcauaaugaaccagcaaacaggggacacgacgcuguggucccuacuuacacagcacaguacacuccaaaauugggucagauucaaauuggcacauggcagaccgaugaucuuacagucaaccaaccagucaaauucaccccaguuggacucaaugacacugaacauuuuaaucagugggugguccccagauacgcuggugcccuaaaccucaacacaaaccuugccccuucuguugcuccgguauuuccaggggagcgccugcuuuucuucagaucauacguuccccucaagggugguuauggaaauccagccauugauugcuuauuaccacaagagugggugcaacacuucuaucaggaagcugccccaucaaugagugagguggcccuugucagauacaucaacccggauacuggucgggcacuguuugaggccaagcuccacagagcugguuucaugacagucucgagcaacaccagugccccggugguugugccugccaauggguacuucagauuugacucuuggguuaaucaauucuauucucucgcccccaugggaacuggaaaugggcguagaaggguucaauaa

SEQ ID NO: 5628 - RNA, 1644 nt, Artificial Sequence
  VP1__Norovirus__BAL14785
augaagauggcgucgaaugacgcugcuccaucgaaugauggugcugccaaccucguaccagaggccaacaaugagguuauggcacuugaaccgguggugggagccucaaucgcagcuccugucgucggccaacaaaacauaauugaccccuggauuagagaaaauuuuguucaagcaccacagggcgaguucaccgucucaccgaggaacucgccuggugagaugcuauuaaaucuugaauugggcccagaacucaacccuuaccuaagucaccugucccguauguauaauggguaugcugguggcaugcagguucaggugguccuagcugggaaugcguucacagcugggaaaaucaucuuugccgccguaccaccacauuuucccguggaaaacauuagugcagcucaaauaacuauguguccccauguaauuguugaugugagacaacuugaaccaguacuucugccccuucccgacauaaggaauagguucuuucacuacaaucaggagaacaccccccggaugagacuuguggcuaugcuuuacaccccccugagggccaacucuggugaagauguguuuacugucucuuguagggucuugacccguccugccccugauuuugaauuuacuuucuugguaccaccaacuguugaaucaaagacuaaaccuuucacacugcccauauuaacucuuggugagcuaucuaacuccagauucccagccccaauagauauguuguacacugacccaaaugagggaauugugguccaaccacaaaaugguaggugcacucuugauggcacucugcaaggcaccacacaacugguccccacccaaaucugugcuuucaggggcacacuaauuggccaaacaucaagaucuucagacucaaccgacucagccccucggagaagggaucacccacuccaugugcaauuaaagaaccuugauggcacgcaauacgacccaacugaugaagugccagcaguccuuggugccauugacuucaaggggacugucuuugggguggccagucagagagacgugucagggcaacaagugggagcaacucgagcccaugaagugcacaucagcacaaccgauccuagguauacaccaaaacugggauccauucucaugcgcucagagucggacgacuuugugacuggacagccgguccgcuucacaccuauaggaaugggugacaacgacuggcaccagugggagcugccugacuacucuggacaccuaacccugaacaugaaccucgccccagcagucgcuccugcuuuuccgggcgagaggauucuuuucuucaggucaaugguuccgucugcugguggcuaugggucuggacaaauagauugccucauaccacaggaguggguucagcauuucuaccaggaagcugcaccaucccaaucugccguggcacucauuagguaugucaauccagacacaggcagaaacaucuuugaggcuaaauugcacagggaagguuucaucaccguggcaaauucugguaacaaccccauuguuguccccccuaauggguauuuuagguuugaggcuugggugaaucaauuuuacacuuugacccccaugggaacuggucaggggcguaggaggaaucaguaa

SEQ ID NO: 5629 - RNA, 1749 nt, Artificial Sequence
  VP1__Norovirus__BAR88157
augaagauggcgucuagugacgcugcgucuccaucuucggauggggcagccaaccucguaccagagaucaacaaugagguuauggcuuuagaaccaguggccggcgcacaauuggcagccccggucgccgaccaauucaaugcaauugaucccuggauaaggcaaaauuuuguucaagcuccugagggcgaauucacggucuccccucgaaacgccccaggugagauccuucugaacuuggaguuggguccacaccucaaccccuuccuucaacaccuggcccaaauguacaaugccuaugcuggcggcauggaggugcaaguuguccucgccgggaacgcguucaccgccgggaagaucaucuucgcugcuaucccuccacacuucccuccugagaggcucucugcggcgcaggccacgcaguucccccacgugauaauugacgugaggcaacuugagcccauagucuugccccuccccgacguaaggcacaaccuguuccacuucaaccagcagaaugaugagaggaugcgucugguugccuuucuguacaccccccugcgugcgaacucugggagcggugacgauguguucacgguguccugccgggucuugacucgacccucuccggauuucgaguucauguuuuugguccccccuacgguugagaggaagacgguggcauucucacucccccaguugaccgucggggagaugucaaacucaagguggcccgcccguaucacaaccaugauugccgacccucaccucccccagguucugcgcauccagaaugggcggugcacccuagacgggacgcucaugggcaccacccagcucaacccuaacgacaucugcaggguucgaggauauuucuccaacucgaggccucaagugaugugugagggcgaggacgaugcgcucgaccaggcgucccucggagccgagcccauccgcgaccaggcgccggggcugaggacccaggcgcgcucgaccgagcggugguucgcugugacggaacucaauggacaggccuaugaccccuuuggugaccaaccagcgccacucgggguuccugacuucgaggcgcgcauagucggcgcucuaguacgccuaccugggacuaacccaacguccaacucgagguucgaggacgcguggauugacaccaacaaucagaccaccuacgcgcccgcggccgggaugguugccaucacgaccagugacgacaguuccuccaacuacgccaaugaccaggugugcgaguuccucccacuagguguugacaucacgaacuccacucccuacaaugaguuugauuugcccaguuauggugguucagcuuccucaggcaaccgcaaucuggccccuacgguugcccccacauucccaggcgagauuguccuccuguuuggaucgaacaugcccguccaaaacaggagugcaggcaccagcaauaaggagauacgaugccucuugccuaaugaguacauccagcaccucuaugacacacaggccccuaguuugagcgacguugcucuugucagauacauuaacccugacaccgggcgcguucuauuugaggccaaguugcaccgcgauggcuucaugacagugaacgcauccgcuaccacaguucugccuguggaugggcacuuccgcuuugacuccugggucaaccaauucuaugcacucagcccuguggguaacgccucuggcaggcgugggcgcaacaggcggguugacuga

SEQ ID NO: 5630 - RNA, 1623 nt, Artificial Sequence
  VP1__Norovirus__BAS29993
augaagauggcgucuaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugagucccagccaggucacuauguucccccacauaauaguggauguuaggcaauuggaaccuguguugaucccccuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggccucucuaaauuggaacaauuaugacccaacagaagaaauuccagccccucuaggaacuccagauuuugugggaaagauccaaggugugcucacucaaaccacaaagggagauggcucgacccguggccauaaagcuacaguuuacacugggagugcccccuuuacuccaaagcugggcaguguccaauucaguacugauacagagaaugauuuugaaacucaccaaaacacaaaguucaccccagucggugucauccaggaugguggcaccacccaucgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccuacucccccaggagugggugcagcacuucuaccaagaagcagcuccggcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauuuuacacacuugcccccaugggaaauggaacggggcguaggcgugcuuuauaa

SEQ ID NO: 5631 - RNA, 1623 nt, Artificial Sequence
  VP1__Norovirus__BAS29996
augaagauggcgucgaaugacgccaccccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugagucccagccaggucacuauguucccccacauaauaguggauguuaggcaauuggaaccuguguugaucccccuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggccucucuaaauuggaacaauuaugacccaacagaagaaauuccagccccucuaggaacuccagauuuugugggaaagauccaaggugugcucacucaaaccacaaagggagauggcucgacccguggccauaaagcuacaguuuacacugggagugcccccuuuacuccaaagcugggcaguguccaauucaguacugauacagagaaugauuuugaaacucaccaaaacacaaaguucaccccagucggugucauccaggaugguggcaccacccaucgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccuacucccccaggagugggugcagcacuucuaccaagaagcagcuccggcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauuuuacacacuugcccccaugggaaauggaacggggcguaggcgugcuuuauaa

SEQ ID NO: 5632 - RNA, 1623 nt, Artificial Sequence
  VP1__Norovirus__BAS29999
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugaucccccuaccugauguuaggaauaacuucuaucacuauaaucagucaaaugauucuacuauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuugggcaccacccaacugucuccugucaacaucugcacuuucagaggggaugucacccacauugcagguucucgugauuacacaaugaauuuggccucucuaaauuggaacaauuaugacccaacagaagaaauuccagccccucuaggaacuccagauuuugugggaaagauccaaggugugcucacucaaaccacaaagggagauggcucgacccguggccauaaagcuacaguuuacacugggagugcccccuuuacuccaaagcugggcaguguccaauucaguacugauacagagaaugacuuugaaacucaccaaaacacaaaguucaccccagucgguguuauccaggaugguggcaccacccaucgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccuacucccccaggagugggugcagcacuucuaccaagaagcagcuccggcacaaucugaaguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauuuuacacacuugcccccaugggaaauggaacggggcguagacgugcuuuauaa

SEQ ID NO: 5633 - RNA, 1623 nt, Artificial Sequence
  VP1__Norovirus__BAS30005
augaagauggcgucgaaugacgccaacccaucugauggguccgcagccaaccucgucccagaggucagcaacgagguuauggcuuuggagcccguugucggugccgcuauugcggcgccuguagcgggccaacaaaaugugauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggccugagucccagccaggucaccauguucccccacauaauaguagauguuaggcaauuggaaccuguguugauccccuuaccugauguuaggaauaauuucuaucacuauaaucagucaaaugauucuaccauuaaauugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaauaauuaugacccaacagaagaaauuccagccccucugggaacuccagauuucgugggaaagauccaaggugugcucacucaaaccacaaagggagauggcucgacccguggccauaaagcuacaguuuacacugggagugcccccuuuacuccaaagcuggguaguguucaauucaguacugauacagaaaaugauuuugaaacucaccaaaacacaaaauucaccccagucggugucauccaggaugguagcaccacccaccgaaaugaaccccaacaaugggugcucccaaguuacucagguagagauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcccuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacucgcccccaugggaaauggaacggggcguagacgugcuuuauaa

SEQ ID NO: 5634 - RNA, 1623 nt, Artificial Sequence
  VP1__Norovirus__BAS30008
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccugucucauuuggccagaauguauaaugguuaugcaggugguuuugaagugcaggugauccucgcggggaacgcguucaccgccgggaaaauuauauuugcagcagucccaccaaauuuuccaacugaaggcuugagucccagccaggucacuauguucccccacauaauaguagauguuaggcaauuggaacccguguugauccccuuaccugauguuaggaauaacuucuaucauuauaaucagucaaaugauucuaccauuaaacugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaauuuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucagaccacgaagggagauggcucgacccguggucauaaagcuacaguuuacacugggagugcccccuucacuccaaagcugggcaguguucaauucaguacugauacagaaaaugauuuugaagcucaccaaaacacaaaauucaccccagucggugucauccaggaugguagcaccacccaccgaaaugaaccccaacaaugggugcucccaaguuauucagguggaaauguucaaaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcccacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5635 - RNA, 1623 nt, Artificial Sequence
  VP1__Norovirus__BAS30011
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccugucucauuuggccagaauguauaaugguuaugcaggugguuuugaagugcaggugauccucgcggggaacgcguucaccgccgggaaaauuauauuugcagcagucccaccaaauuuuccaacugaaggcuugagucccagccaggucacuauguucccccacauaauaguagauguuaggcaauuggaacccguguugauccccuuaccugauguuaggaauaacuucuaucauuauaaucagucaaaugauucuaccauuaaacugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaauuuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucagaccacgaagggagauggcucgacccguggucauaaagcuacaguuuacacugggagugcccccuucacuccaaagcugggcaguguucaauucaguacugauacagaaaaugauuuugaagcucaccaaaacacaaaauucaccccagucggugucauccaggaugguagcaccacccaccgaaaugaaccccaacaaugggugcucccaaguuauucagguagaaauguucaaaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcccacaccggccagcaugauuuggucaucccccccaauggcuauuuuagguuugauuccuggguuaaucaauucuacacacuugcccccaugggaaauggaacggggcguagacgugcuuuauaa

SEQ ID NO: 5636 - RNA, 1623 nt, Artificial Sequence
  VP1__Norovirus__BAS30014
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaacaacuucuaucacuauaaucagucaaaugauucuaccauuaaauugauagcaauguuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaaccccagauuucgugggaaagauccaaggagugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccauuuuuccgggugaacaacuucuuuucuuuagguccacuaugcccggaugcagcggguaucccaacauggauuuggauugccugcucccccaggagugggugcagcacuucuaccaagaggcagcuccagcacaaucugauguggcgcuauugagauuugugaauccagacacggguaggguccuguuugagugcaagcuccacaaaucaggcuaugucacaguggcucacaccggccagcaugaucuggucaucccccccaaugguuauuuuagguuugauuccuggguuaaucaguucuacacacuugcccccaugggaaaugggacggggcguagacgugcuuuauaa

SEQ ID NO: 5637 - RNA, 1623 nt, Artificial Sequence
  VP1__Norovirus__BAS30017
augaagauggcgucgaaugacgccaacccaucugauggguccgcagccaaccucgucccggaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccauauaauaguggauguuaggcaauuggaaccuguguugauccccuuaccugauguuaggaauaauuucuaccauuauaaucagucaaaugauucuaccauuaaauugauagcaauguuguauacaccacuuagggcuaauaaugcuggggaagaugucuuuacagucucuugucgaguucucacgaggccauccccugauuuugauuuuauauucuuggugccaccuacaguugagucaagaacuaaaccauuuacugucccaaucuuaacuguugaagaaaugaccaauucaagauuccccauuccuuuggaaaaauuguucacgggucccagcaguaccuuuguuguucaaccacaaaauggcagaugcacgacugauggcgugcucuuaggcaccacccaacuguccccugucaacaucugcaccuucagaggggaugucacccacauugcagguucucguaauuauacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucgguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccaggugaacaacuucuuuucuuuagguccacuaugcccggaugcagcggguaucccaacauggauuuggauugccugcucccccaggagugggugcagcacuuuuaccaagaggcagcuccagcacaaucugauguggcucuauugagauuuguaaauccagacacggguaggguucuguuugagugcaaacuucacaaaucaggcuaugucacaguggcucacaccggccagcaugauuuggucaucccccccaauggcuauuucagguuugauuccuggguuaaucaguucuacacacuugcccccaugggaaauggaacggggcguagacgugcuuuauaa

SEQ ID NO: 5638 - RNA, 1623 nt, Artificial Sequence
  VP1__Norovirus__BAS30023
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucacuuggccagaauguauaaugguuaugcaggugguuuugaagugcaggugauccucgcggggaacgcguucaccgccggaaaaauuauauuugcagcagucccaccaaauuuuccaauugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaauguuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaaccccagauuucgugggaaagauucagggagugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuucagguccacuaugcccggaugcagcggguaucccaacauggauuuggauugccugcucccccaggagugggugcagcacuucuaccaagaggcagcuccagcacaaucugauguggcucuauugagauuugugaauccagacacggguaggguccuguuugagugcaagcuucacaaaucaggcuaugucacaguggcucacaccggccagcaugauuuggucaucccccccaaugguuauuuuagguuugauuccuggguuaaucaguucuacacacuugcccccaugggaaauggaacggggcguagacgugcuuuauaa

SEQ ID NO: 5639 - RNA, 1623 nt, Artificial Sequence
  VP1__Norovirus__BAS30026
augaagauggcgucgaaugacgccaacccaucugauggguccgcagccaaccucgucccagaggucaacaaugagguuauggcuuuggagcccguugucggugccgcuauugcggcgccuguagcgggccaacaaaaugugauugaccccuggauuagaaauaauuuuguacaagccccugguggagaguucacaguauccccuagaaacgcuccaggugaaauacuauggagcgcgcccuuaggcccugauuugaaucccuaccuaucucauuuggccagaauguauaaugguuaugcaggugguuuugaagugcaagugauccucgcggggaacgcguucaccgccgggaaaauuauauuugcagcagucccaccaaauuuuccaacugaagguuugagucccagccagguuacuauguucccccacauaauaguagauguuaggcaauuggaaccuguguugaucccuuuaccugauguuaggaauaacuucuaccacuauaaucagucaaaugauucuaccauuaaauugauagcaaugcuguacacaccacuuagggccaauaaugcuggggaugaugucuucacagucucuugucgaguccucacgagaccauccccugauuuugauuuuauauuucuggugccacccacaguugagucaagaaccaagccauucacugucccaaucuuaacuguugaagaaaugaccaauucaagauuccccauuccuuuggaaaaacuguucacgggucccagcagugccuuuguuguucaaccacaaaauggcagaugcacuacugauggcgugcucuuaggcaccacccaacugucuccugucaacaucugcaccuucagaggagaugucacccacauugcggguucccgcaauuacacaaugaauuuggccucucuaaauuggaacaauuacgacccaacagaagaaauuccagccccccugggaacuccagauuuugugggaaagauccaaggugugcucacucaaaccacaaagggagacggcucgacccggggccauaaagcuacaguuuacacugggagugccgacuuuacuccaaagcugggcaguguccaauuugguacugauacagaaaaugacuuugaaacucaccaaaacacaaaauucaccccaguaggugucauccaggaugguagcaccacccaccgaaaugaaccccaacaaugggugcucccaaguuauucagguagaaauguccauaauguacaccuagccccugcuguagcucccaauuuuccgggugaacaacuucuuuucuucagguccacuaugcccggauguagcggguaucccaacauggauuuggauugccugcucccccaggagugggugcagcacuucuaccaagaggcagcuccagcacaaucugauguggcucuauugagauuugugaauccagacacggguaggguccuguuugagugcaaacuccauaaaucaggcuaugucacaguggcucacaccggccaacaugauuuggucaucccccccaauggcuauuuuagguuugauuccuggguuaaccaauucuacacacuugcccccaugggaaauggaacggggcguagacgugcuuuauaa

SEQ ID NO: 5640 - RNA, 1623 nt, Artificial Sequence
  VP1__Norovirus__BAS30029
augaagauggcgucuaaugacgccagcccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuagggacuccagauuucgugggaaagauccaagguguacucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaguucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5641 - RNA, 1623 nt, Artificial Sequence
  VP1__Norovirus__BAS30035
augaagauggcgucuaaugacgccaacccaucugauggguccgcagccaaccucgucccggaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaccugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccauauaauaguggauguuaggcaauuggaaccuguguugauccccuuaccugauguuaggaauaauuucuaccauuauaaucagucaaaugauucuaccauuaaauugauagcaauguuguauacaccacuuagggcuaauaaugcuggggaagaugucuuuacagucucuugucgaguucucacgaggccauccccugauuuugauuuuauauucuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacuguccccugucaacaucugcaccuucagaggggaugucacccacauugcagguucucguaauuauacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucgguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccaggugaacaacuucuuuucuuuagguccacuaugcccggaugcagcggguaucccaacauggauuuggauugccugcucccccaggagugggugcagcacuuuuaccaagaggcagcuccagcacaaucugauguggcucuauugagauuuguaaauccagacacggguaggguucuguuugagugcaaacuucacaaaucaggcuaugucacaguggcucacaccggccagcaugauuuggucaucccccccaauggcuauuucagguuugauuccuggguuaaucaguucuacacacuugcccccaugggaaauggaacggggcguagacgugcuuuauaa

SEQ ID NO: 5642 - RNA, 1623 nt, Artificial Sequence
  VP1__Norovirus__BAS30038
augaagauggcgucuaaugacgccaacccaucugauggguccgcagccaaccucgucccggaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccauauaauaguggauguuaggcaauuggaaccuguguugauccccuuaccugauguuaggaauaauuucuaccauuauaaucagucaaaugauucuaccauuaaauugauagcaauguuguauacaccacuuagggcuaauaaugcuggggaagaugucuuuacagucucuugucgaguucucacgaggccauccccugauuuugauuuuauauucuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacuguccccugucaacaucugcaccuucagaggggaugucacccacauugcagguucucguaauuauacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucgguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccaggugaacaacuucuuuucuuuagguccacuaugcccggaugcagcggguaucccaacauggauuuggauugccugcucccccaggagugggugcagcacuuuuaccaagaggcagcuccagcacaaucugauguggcucuauugagauuuguaaauccagacacggguaggguucuguuugagugcaaacuucacaaaucaggcuaugucacaguggcucacaccggccagcaugauuuggucaucccccccaauggcuauuucagguuugauuccuggguuaaucaguucuacacacuugcccccaugggaaauggaacggggcguagacgugcuuuauaa

SEQ ID NO: 5643 - RNA, 1623 nt, Artificial Sequence
  VP1__Norovirus__BAS30041
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaauugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaauguuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaaccccagauuucgugggaaagauucagggagugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuucagguccacuaugcccggaugcagcggguaucccaacauggauuuggauugccugcucccccaggagugggugcagcacuucuaccaagaggcagcuccagcacaaucugauguggcucuauugagauuugugaauccagacacggguaggguccuguuugagugcaagcuucacaaaucaggcuaugucacaguggcucacaccggccagcaugauuuggucaucccccccaaugguuauuuuagguuugauuccuggguuaaucaguucuacacacuugcccccaugggaaauggaacggggcguagacgugcuuuauaa

SEQ ID NO: 5644 - RNA, 1623 nt, Artificial Sequence
  VP1__Norovirus__BAS30044
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgagcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaauuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuucauauuuuuggugccaccuacaguugagucaagaacuaaaccauuuacugucccaaucuuaacuguugaagaaaugaccaacucaagauuccccauuccuuuggagaaguuguucacaggucccagcagugccuuuguuguucaaccacaaaauggcagaugcacaacugauggcgugcucuuaggcaccacccagcugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuucacuccaaagcugggcaguguccaauucaguacugauacagaaaaugauuuugaaacccaccaaaacacaaaauucaccccagucggugucauccaggaugguggcaccacccaccgaaaugaaccucaacaaugggugcucccaaguuauucagguagaaaugucccuaauguacaccuagcccccgcuguagcccccacuuuuccgggugaacaacuucuuuucuuuagguccacuaugcccggaugcagcggguaucccaacauggauuuggacugccuacuaccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaaugguuauuuuagguuugacuccuggguuaaucaauucuacacgcuugcccccaugggaaauggaacggggcguagacgugcuuuauaa

SEQ ID NO: 5645 - RNA, 1623 nt, Artificial Sequence
  VP1__Norovirus__BAS30047
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaauuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuucauauuuuuggugccaccuacaguugagucaagaacuaaaccauuuacugucccaaucuuaacuguugaagaaaugaccaacucaagauuccccauuccuuuggagaaguuguucacaggucccagcagugccuuuguuguucaaccacaaaauggcagaugcacaacugauggcgugcucuuaggcaccacccagcugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuucacuccaaagcugggcaguguccaauucaguacugauacagaaaaugauuuugaaacccaccaaaacacaaaauucaccccagucggugucauccaggaugguggcaccacccaccgaaaugaaccucaacaaugggugcucccaaguuauucagguagaaaugucccuaauguacaccuagccccugcuguagcccccauuuuuccgggugaacaacuucuuuucuuuagguccacuaugcccggaugcagcggguaucccaacauggauuuggacugccuacuaccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaaugguuauuuuagguuugauuccuggguuaaucaauucuacacgcuugcccccaugggaaauggaacggggcguagacgugcuuuauaa

SEQ ID NO: 5646 - RNA, 1623 nt, Artificial Sequence
  VP1__Norovirus__BAS30050
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaauuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuucauauuuuuggugccaccuacaguugagucaagaacuaaaccauuuacugucccaaucuuaacuguugaagaaaugaccaacucaagauuccccauuccuuuggagaaguuguucacgggucccagcagugccuuuguuguucaaccacaaaauggcagaugcacaacugauggcgugcucuuaggcaccacccagcugucuccugucaacaucugcaccuucagaggggaugucacccacauugcagguucucguaauuacacaaugaauuuggcuucccuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuucacuccaaagcugggcaguguccaauucaguacugauacagaaaaugauuuugaaacccaccaaaacacaaaauucaccccagucggugucauccaggaugguggcaccacccaccgaaaugaaccucaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccugcuaccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaaugguuauuuuagguuugauuccuggguuaaucaauucuacacgcuugcccccaugggaaauggaacggggcguagacgugcuuuauaa

SEQ ID NO: 5647 - RNA, 1623 nt, Artificial Sequence
  VP1__Norovirus__BAS30053
augaagauggcgucgaaugacgccaccccaucugauggguccgcagccaaccucgucccggaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcgggugguuuugaagugcaggugauccucgcggggaacgcguucaccgccgggaaaauuauauuugcagcagucccaccaaauuuuccaacugaaggcuugagucccagccaggucacuauguucccccauauaauaguggauguuaggcaauuggaaccuguguugauccccuuaccugauguuaggaauaacuucuaccauuauaaucagucaaaugauucuaccauuaaauugauagcaauguuguauacaccacuuagggcuaauaaugcuggggaagaugucuuuacagucucuugucgaguucucacgaggccauccccugauuuugauuuuauauucuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacuguccccugucaacaucugcaccuucagaggggaugucacccacauugcagguucucguaauuauacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccacaaagcuacaguuuacacugggagugcccccuuuacuccaaagcugggcaguguucaauucaauacugauacagaaaaugauuuugaaacucaccaaaacacaaaauucaccccagucggugucauccaggaugguagcaccacccaccgaaaugaaccccaacaaugggugcucccaaguuauucagguagaaaugucccuaauguacaccuagccccugcuguagcccccacuuuuccaggugaacaacuucuuuucuuuagguccacuaugcccggaugcagcggguaucccaacauggauuuggauugccugcucccccaggagugggugcagcacuuuuaccaagaggcagcuccagcacaaucugauguggcucuauugagauuuguaaauccagacacggguaggguucuguuugagugcaaacuucacaaaucaggcuaugucacaguggcucacaccggccagcaugauuuggucaucccccccaauggcuauuucagguuugauuccuggguuaaucaguucuacacacuugcccccaugggaaauggaacggggcguagacgugcuuuauaa

SEQ ID NO: 5648 - RNA, 1623 nt, Artificial Sequence
  VP1__Norovirus__BAS30056
augaagauggcgucuaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaggugcaggugauccucgcggggaacgcguucaccgccggaaaaauuauauuugcagcagucccaccaaauuuuccaauugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaauguuguauacaccacuuagggcuaauaaugcuggggaggaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaaccccagauuucgugggaaagauucaaggagugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuucagguccacuaugcccggaugcagcggguaucccaacauggauuuggauugccugcucccccaggagugggugcagcacuucuaccaagaggcagcuccagcacaaucugauguggcuuuauugagauuugugaauccagacacggguaggguccuguuugagugcaagcuucacaaaucagguuaugucacaguggcucacacuggccagcaugauuuggucaucccccccaaugguuauuuuagguuugauuccuggguuaaucaguucuacacacuugcccccaugggaaauggaacggggcguagacgugcuuuauaa

SEQ ID NO: 5649 - RNA, 1623 nt, Artificial Sequence
  VP1__Norovirus__BAS30059
augaagauggcgucgaaugacgccaacccaucugauggguccgcagccaaccucgucccagaggucaacaaugagguuauggcucuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucuuaaucccuaccuaucucauuuggccagaauguauaaugguuaugcaggugguuuugaagugcaggugauccucgcggggaacgcguucaccgccggaaaaauuauauuugcagcagucccaccaaauuucccaacugaaggcuugagucccagccaggucacuauguucccccacauaauaguggauguuagacaauuggaaccuguguugauccccuuaccugauguuaggaauaacuucuaucauuauaaucagucaaaugauucuacuauuaaauugauagcaauguuguauacaccacuuagggcuaauaaugcuggggaagaugucuuuacagucucuugucgaguucucacgaggccauccccugauuuugauuucauauuuuuggugccaccuacaguugagucuagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcuuuuaggcaccacccaacugucucccgucaacaucugcaccuuuagaggggaugucacccacauugcagguucucguaauuacacaaugaauuuggcuucucuaaauuggaacaauuaugacccaacagaagaaauuccagccccucuaggaacuccagauuucgugggaaagauccaggguguacucacucaaaccacaaagggagauggcucgacccguggccauaaagcuacagucuacacugggagugcccccuuuacuccaaagcugggcaguguucaauucaguacugauacagaaaaugauuuugaaacucaccaagacacaaaauucaccccagucggugucauccaggaugguggcacaacccaccgaaaugaaccccaacaaugggugcucccaagcuauucugguagaaaugucccuaauguacaccuagccccugcuguagcccccacuuucccgggugaacaacuucuuuucuuuagguccacuaugcccggaugcagcggguaucccaacauggauuuggauugccugcucccccaggagugggugcagcacuucuaccaagaggcagcuccagcacaaucugauguggcucuauugagauuugugaacccagacacggguaggguccuguuugagugcaaacuccacaaaucaggcuaugucacaguggcucauaccggccagcaugauuuggucaucccccccaaugguuauuuuagguuugauuccuggguuaaucaauucuacacacuugcccccaugggaaaugggacggggcguagacgugcuuuauaa

SEQ ID NO: 5650 - RNA, 1623 nt, Artificial Sequence
  VP1__Norovirus__BAS30062
augaagauggcgucgaaugacgccaacccaucugauggguccgcagccaaccucgucccagaggucaacaaugagguuauggcuuuggagcccguugucggugccgcuauugcggcgccuguagcgggccagcaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccucacauaauaguggauguuaggcaauuggaaccuguguugauccccuuaccugauguuaggaauaacuucuaucacuacaaucagucaaaugauucuaccauuaaauugauagcaaugcuauauacaccacuuagggcuaacaaugcuggggaggaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuucguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacaguuuacacugggagugcccccuuuacuccaaagcuggguaguguccaguucaguacugauacagaaaaugauuuugaaacucaccaaaacacaaaauucaccccagucggugucauccaggaugguggcaccacccaccgaaaugaaccccaacaaugggugcucccaaguuauucagguagaaauguccaaaauguacaccuagccccugcuguagcccccacuuuuccgggugaacaacuucuuuucuuuagguccacuaugcccggaugcagcggguauccuaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuacgucacaguggcucauaccggucagcaugauuuggucaucccccccaaugguuauuuuagguuugauuccuggguaaaucaauucuacacacuugcccccaugggaaauggaacggggcgcagacgugcuuuauaa

SEQ ID NO: 5651 - RNA, 1623 nt, Artificial Sequence
  VP1__Norovirus__BAS30065
augaagauggcgucgaaugacgccaacccaucugauggguccgcagccaaccucgucccagaggucaacaaugagguuauggcuuuggagcccguuguuggugccgccauugcggcgccuguagcgggccaacaaaauguaauugaccccuggauuagaaauaauuuuguacaagccccugguggagaguuuacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgucgugaaaacuacuuugucagcagucccaccaaauuucccaacugaaggcuugagucccagccaggucacuauguucccccacauaauaguggauguuaggcaauuggaaccuguguugaucccccuaccugauguuaggaauaacuucuaucacuauaaucagucaaaugauucuaccauuaaauugauagcaaugcuguauacaccacuuagggcuaauaaugcuggggaggaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggccucucuaaauuggaacaauuaugacccaacagaagaaauuccagccccucuaggaacuccagauuuugugggaaagauccaaggugugcucacucaaaccacaaagggagauggcucgacccguggccauaaagcuacaguuuacacugggagugcccccuuuacuccaaagcugggcaguguccaauucaguacugauacagagaaugauuuugaaacucaccaaaacacaaaguucaccccggucggugucauccaggaugguggcaccacccaucgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccuacucccccaggagugggugcagcacuucuaccaagaagcagcuccggcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauuuuacacacuugcccccaugggaaauggaacggggcguagacgugcuuuauaa

SEQ ID NO: 5652 - RNA, 1623 nt, Artificial Sequence
  VP1__Norovirus__BAS30068
augaagauggcgucgaaugacgccaccgcaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaauugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaauguuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaaccccagauuucgugggaaagauucaaggagugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuucagguccacuaugcccggaugcagcggguaucccaacauggauuuggauugccugcucccccaggagugggugcagcacuucuaccaagaggcagcuccagcacaaucugauguggcucuauugagauuugugaauccagacacggguaggguccuguuugagugcaagcuucacaaaucaggcuaugucacaguggcucacaccggucagcaugauuuggucaucccccccaaugguuauuuuagguuugauuccuggguuaaucaguucuacacacuugcccccaugggaaauggaacggggcguagacgugcuuuauaa

SEQ ID NO: 5653 - RNA, 1623 nt, Artificial Sequence
  VP1__Norovirus__BAS30071
augaagauggcgucuaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaauugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaauguuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccuguuaacaucugcaccuucagaggggaugucacccacauugcagguucucguaauuacacaaugaauuuggcuucucuaaauuggaacaauuaugacccaacagaagaaauuccagccccucuaggaaccccagauuucgugggaaagauucagggagugcucacucaaaccacaaagggagauggcucgacccguggccauaaagcuacaguuuacacugggagugcccccuuuacuccaaagcugggcaguguucaauucaguacugauacagaaaaugauuuugaaacucaccagaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuucagguccacuaugcccggaugcagcggguaucccaacauggauuuggauugccugcucccccaggagugggugcagcacuucuaccaagaggcagcuccagcacaaucugauguggcucuauugagauuugugaauccagacacggguaggguccuguuugagugcaagcuucacaaaucaggcuaugucacaguggcucacaccggccagcaugauuuggucaucccccccaaugguuacuuuagguuugauuccuggguuaaucaguucuacacacuugcccccaugggaaauggaacggggcguagacgugcuuuauaa

SEQ ID NO: 5654 - RNA, 1623 nt, Artificial Sequence
  VP1__Norovirus__BAS30074
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaauugaaggcuugagucccagccaggucacuauguucccccacauaauaguggauguuaggcaauuggaaccuguguugauccccuuaccugauguuaggaauaauuucuaucacuauaaucagucaaaugauucuaccauuaaauugauagcaauguuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaaccccagauuucgugggaaagauucaaggagugcucacucaaaccacaaagggagauggcucgacccguggccauaaagcuacaguuuacacugggagugccccuuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuucagguccacuaugcccggaugcagcggguaucccaacauggauuuggauugccugcucccccaggagugggugcagcacuucuaccaagaggcagcuccagcacaaucugauguggcucuauugagauuugugaauccagacacggguaggguccuguuugagugcaagcuucacaaaucaggcuacgucacaguggcucacaccggccagcaugauuuggucaucccccccaaugguuauuuuagguuugauuccuggguuaaucaguucuacacacuugcccccaugggaaauggaacggggcguagacgugcuuuauaa

SEQ ID NO: 5655 - RNA, 1623 nt, Artificial Sequence
  VP1__Norovirus__BAS30077
augaagauggcgucuaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaauucacaguauccccuagaaacgcuccaggugaaauacuauggagcgcgcccuuaggcccugaucugaaucccuaccuaucccauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguuuccccacauaauaguggauguuaggcaauuggaaccuguguugauccccuuaccugauguuaggaauaacuucuaccacuauaaucagucaaaugauucuaccauuaaauugauagcaaugcuguauacaccacuuagggcuaauaaugcuggggaggaugucuucacagucucuugucgaguccucacgaggccauccccugauuuugacuuuauauuuuuggugccaccuacaguugagucaagaacuaaaccauuuacugucccaaucuugacuguugaagaaaugaccaauucgagauuccccauuccuuuggaaaaauuguuuacgggucccagcagugccuuuguuguucaaccacaaaauggcagaugcacgacugauggcgugcucuuaggcaccacccaacugucuccugucaacaucugcaccuucagaggggaugucacccacauugcagguucucauaauuacacaaugaauuuggcuucucuaaauuggaacaacuaugacccaacagaagaaauuccagccccucuaggaaccccagauuucgugggaaagauccaaggugugcucacucaaaccacaaagggagaugguucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccgcccaccgaaaugaaccccaacaaugggugcucccaaguuauucagguagaaauguccaaaauguacaccuagccccugcuguagcccccacguuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaagcuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5656 - RNA, 1623 nt, Artificial Sequence
  VP1__Norovirus__BAS30080
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggccaaauuauauuugcagcagucccaccaaauuuuccaacugaaggcuugagucccagccaggucacuauguucccccacauaauaguagauguuaggcaauuggaaccuguguugauccccuuaccugauguuaggaauaauuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuucauauuuuuggugccaccuacaguugagucaagaacuaaaccauuuacugucccaaucuuaacuguugaagaaaugaccaacucaagauuccccauuccuuuggagaaguuguucacgggucccagcagugccuuuguuguucaaccacaaaauggcagaugcacaacugauggcgugcucuuaggcaccacccagcugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuucacuccaaagcugggcaguguccaauucaguacugauacagaaaaugauuuugaaacccaccaaaacacaaaauucaccccagucggugucauccaggaugguggcaccacccaccgaaaugaaccucaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccuacuaccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaaugguuauuuuagguuugauuccuggguuaaucaauucuacacgcuugcccccaugggaaauggaacggggcguagacgugcuuuauaa

SEQ ID NO: 5657 - RNA, 1623 nt, Artificial Sequence
  VP1__Norovirus__BAS30083
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaauuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuucauauuuuuggugccaccuacaguugagucaagaacuaaaccauuuacugucccaaucuuaacuguugaagaaaugaccaacucaagauuccccauuccuuuggagaaguuguucacgggucccagcagugccuuuguuguucaaccacaaaauggcagaugcacaacugauggcgugcucuuaggcaccacccagcugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuucacuccaaagcugggcaguguccaauucaguacugauacagaaaaugauuuugaaacccaccaaaacacaaaauucaccccagucggugucauccaggaugguggcaccacccaccgaaaugaaccucaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccuacuaccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaaugguuauuuuagguuugauuccuggguuaaucaauucuacacgcuugcccccaugggaaauggaacggggcguagacgugcuuuauaa

SEQ ID NO: 5658 - RNA, 1623 nt, Artificial Sequence
  VP1__Norovirus__BAS30086
augaagauggcgucgaaugacgccaacccaucugauggguccgcagccaaccucgucccagaggucaacaaugagguuauggcuuuggagcccguugucggugccgcuauugcggcgccuguagcgggccaacagaaugugauugaccccuggauuagaaauaauuuuguacaagccccugguggagaguucacaguauccccuagaaaugcuccaggugaaauacuauggagcgcgcccuuaggcccugaucugaaucccuaccuaucccauuuggccagaauguauaaugguuaugcaggugguuuugaagugcaggugauccucgcggggaacgcguucaccgccggaaaaauuauauuugcagcagucccaccaaacuuuccaacugaaggcuugagucccagccaggucacuauguucccccacauaauaguggauguuaggcaauuggaaccuguguugauccccuuaccugacguuaggaauaauuucuaccacuauaaucagucaaaugauucuacuauuaaauugauagcaaugcuguauacaccacuuagggcuaauaaugcuggggaggaugucuucacagucucuugucgaguccucacgagaccauccccugauuuugauuuuauauuuuuggugccaccuacaguugagucaagaacuaaaccauuuacugucccagucuuaacuguugaagaaaugaccaauucaagauuucccauuccuuuggaaaaguuguuuacgggucccagcagugccuuuguuguucaaccacaaaauggcagaugcacgacugauggcgugcucuuaggcaccacccaacugucuccugucaacaucugcaccuucagaggggaugucacccacauugcaaauucucacaauuacacaaugaauuuggcuucucuaaauuggaacaauuaugacccaacagaagaaauuccagccccucuaggaaccccagauuucgugggaaagauccaaggugugcucacucaaaccacaaagggagaugguucgacccguggccauaaagcuacaguuuacacugggagugcccccuuuacuccaaagcuaggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguccaaaauguacaccuagccccugcuguagcccccacguuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugaguguaagcuucauaaaucaggcuaugucacaguagcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5659 - RNA, 1623 nt, Artificial Sequence
  VP1__Norovirus__BAS30089
augaagauggcgucuaaugacgccaacccaucugauggguccgcagccaaccucgucccagaggucaacaaugagguuauggcuuuggagcccguugucggugccgcuauugcggcgccuguagcgggccaacaaaaugugauugaccccuggauuagaaauaauuuuguacaagccccugguggagaauucacaguauccccuagaaaugcuccaggugaaauacuauggagcgcgcccuuaggcccugaucugaaucccuaccuaucccauuuggccagaauguauaaugguuaugcaggugguuuugaagugcaggugauccucgcggggaacgcguucaccgccggaaaaauuauauuugcagcugucccaccaaauuuuccaacugaaggcuugagucccagccaggucacuauguuuccccacauaauaguggauguuaggcaauuggaaccuguguugauccccuuaccugauguuaggaauaacuucuaccacuauaaucagucaaaugauucuaccauuaaauugauagcaaugcuguauacaccacuuagggcuaauaaugcuggggaugaugucuucacagucucuugucgaguccucacgaggccauccccugauuuugacuuuauauuuuuggugccaccuacaguugagucaagaacuaaaccauuuacugucccaaucuuaacuguugaagaaaugaccaauucaagauuccccauuccuuuggaaaaauuguuuacgggucccagcagugccuuuguuguucaaccacaaaauggcagaugcacgacugauggcgugcucuuaggcaccacccaacugucuccugucagcaucugcaccuucagaggggaugucacccacauugcagguucucgugauuacacaaugaauuuggcuucucuaaauuggaacaacuaugacccaacagaagaaauuccagccccucuaggaaccccagauuucgugggaaagauccaaggugugcucacucaaaccacaaagggagaugguucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccgcccaccgaaaugaaccccaacaaugggugcucccaaguuauucagguagaaauguccaaaauguacaccuagccccugcuguagcccccacguuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaagcuucauaaaucaggcuaugucacaguggcccacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5660 - RNA, 1623 nt, Artificial Sequence
  VP1__Norovirus__BAS30092
augaagauggcgucuaacgacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaggugcaggugauccucgcggggaacgcguucaccgccggaaaaauuauauuugcagcagucccaccaaauuuuccaauugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaauguuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuuuagaggggaugucacccacauugcaaguucucguaauuacacaaugaauuuggcuucucuaaauuggaacaauuaugacccaacagaagaaauuccagccccucuaggaaccccagauuucgugggaaagauucaaggagugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggauggugguaccacccaccgaaaugaaccccaacaaugggugcucccaaguuauucagguagaaaugucccuaauguacaccuagccccugcuguagcccccacuuuuccgggugaacaacuucuuuucuucagguccacuaugcccggaugcagcggguaucccaacauggauuuggauugccugcucccccaggagugggugcagcacuucuaccaagaggcagcuccagcacaaucugauguggcucuauugagauuugugaauccagacacggguaggguccuguuugagugcaagcuucacaaaucaggcuaugucacaguggcucacaccggccagcaugauuuggucaucccccccaaugguuauuuuagguuugauuccuggguuaaucaguucuacacacuugcccccaugggaaauggaacggggcguagacgugcuuuauaa

SEQ ID NO: 5661 - RNA, 1623 nt, Artificial Sequence
  VP1__Norovirus__BAS30095
augaagauggcgucuaaugacgccaacccauuugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucacugccggaaaaauuauauuugcagcagucccaccaaauuuuccagcugaaggcuugagucccagccaggucacuauguucccccacauaauaguggauguuaggcaauuggaaccuguguugauccccuuaccugauguuaggaauaacuucuaucauuauaaccagucaaaugauucuaccauuaaauugauagcaauguuguauacaccacuuagggcuaauaaugcuggggaagaugucuuuacagucucuugucgaguucucacgaggccauccccugauuuugauuuuauauucuuggugccaccuacaguugagucaagaacuaaaccauuuacugucccaaucuuaacuguugaagaaaugaccaauucaagauuccccauuccuuuggaaaaacuguucacgggucccagcagugccuuuguuguucaaccacaaaauggcagaugcacgacugauggcgugcucuuaggcaccacccaacuguccccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagccacaguuuacacugggagugcccccuuuacuccaaagcugggcaguguccaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccaggugagcaacuucuuuucuuuagguccacuaugcccggaugcagcggguaucccaacauggauuuggauugccugcucccccaggaguggguacagcacuucuaccaagaggcagcuccagcacaaucugauguggcucuauugagauuugugaauccagacacggguaggguccuguuugagugcaaacuucacaaaucaggcuaugucacaguggcucacaccggccagcaugauuuggucaucccccccaauggcuauuuuagguuugauuccuggguuaaucaguucuacacacuugcccccaugggaaauggaacggggcguagacgugcuuuauaa

SEQ ID NO: 5662 - RNA, 1623 nt, Artificial Sequence
  VP1__Norovirus__BAS30098
augaagauggcgucuaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaauuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuucauauuucuggugccaccuacaguugagucaagaacuaaaccauuuacugucccaaucuuaacuguugaagaaaugaccaacucaagauuccccauuccuuuggagaaguuguucacgggucccagcagugccuuuauuguucaaccacaaaauggcagaugcacaacugauggcgugcucuuaggcaccacccagcugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuucacuccaaagcugggcaguguccaauucaguacugauacagaaaaugauuuugaaacccaccaaaacacaaaauucaccccagucggugucauccaggaugguggcaccacccaccgaaaugaaccucaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccuacuaccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaaugguuauuuuagguuugauuccuggguuaaucaauucuacacgcuugcccccaugggaaauggaacggggcguagacgugcuuuauaa

SEQ ID NO: 5663 - RNA, 1623 nt, Artificial Sequence
  VP1__Norovirus__BAS30101
augaagauggcgucuaaugacgccaacccaucugauggguccgcagccaaccucgucccagaggucaacaaugagguuauggcuuuggagcccguugucggugccgcuauugcggcgccuguagcgggccaacaaaaugugauugaccccuggauuagaaauaauuuuguacaagccccugguggagaauucacaguauccccuagaaaugcuccaggugaaauacuauggagcgcgcccuuaggcccugaucugaaucccuaccuaucccauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguuuccccacauaauaguggauguuaggcaauuggaaccuguguugauccccuuaccugauguuaggaauaacuucuaccauuauaaucagucaaaugauucuaccauuaaauugauagcaaugcuguauacaccacuuagggcuaauaaugcuggggaggaugucuucacagucucuugucgaguccucacgaggccauccccugauuuugacuuuauauuuuuggugccaccuacaguugagucaagaacuaaaccauuuacugucccaaucuuaacuguugaagaaaugaccaauucgagauuccccauuccuuuggaaaaauuguuuacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaacuaugacccaacagaagaaauuccagccccucuaggaaccccagauuucgugggaaagauccaaggugugcucacucaaaccacaaagggagaugguucgacccguggucauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccgcccaccgaaaugaaccccaacaaugggugcucccaaguuauucagguagaaauguccaaaauguacaccuagccccugcuguagcccccacguuuccgggugaacaacuucuuuucuuuagguccacuaugcccggaugcagcggguaucccaacauggauuuggauugccuacucccccaggagugggugcaacacuucuaccaagaggcagcuccagcacaaucugauguggcucuauugagauuugugaauccagacacggguaggguccuguuugagugcaagcuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5664 - RNA, 1623 nt, Artificial Sequence
  VP1__Norovirus__BAS30104
augaagauggcgucuaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuucccaacugaaggcuugagucccagccaggucacuauguucccccacauaauaguggauguuaggcaauuggaaccuguguugaucccccuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguccaaccacaaaauggcagaugcacgacugauggcgugcucuuaggcaccacccaacugucuccugucaacaucugcaccuucagaggggaugucacccacauugcagguucucgugauuacacaaugaauuuggccucucuaaauuggaacaauuaugacccaacagaagaaauuccagccccucuaggaacuccagauuuugugggaaagauccaaggugugcucacucaaaccacaaagggagauggcucgacccguggccauaaagcuacaguuuacacugggagugcccccuuuacuccaaagcugggcaguguccaauucaguacugauacagagaaugauuuugaaacucaccaaaacgcaaaguucaccccggucggugucauccaggaugguagcaccacccaucgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccugcucccccaggagugggugcagcacuucuaccaagaagcagcuccggcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauuuuacacacuugcccccaugggaaauggaacggggcguagacgugcuuuauaa

SEQ ID NO: 5665 - RNA, 1623 nt, Artificial Sequence
  VP1__Norovirus__BAS30107
augaagauggcgucuaacgacgccaacccaucugauggguccacagccaaccucgucccagaggucaacaaugagguuauggcuuuggagcccguaguuggugccgcuauugcggcaccuguagcgggccaacagaaugugauugaccccuggauuagaaauaauuuuguacaagccccugguggagaguucacaguauccccuagaaaugcuccaggugaaauacuauggagcgcgcccuuaggcccugaucugaaucccuaccuuucccauuuggccagaauguauaaugguuaugcaggugguuuugaagugcaggugauccucgcggggaacgcguucaccgccggaaaaauuauauuugcagcagucccaccaaacuuuccaacugaaggcuugagucccagccaggucacuauguucccccacauaauaguggauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaggaugucuucacagucucuugucgaguccucacgagaccauccccugauuuugauuuuauauuuuuggugccaccuacaguugagucaagaacuaaaccauuuacugucccaaucuuaacuguugaagaaaugaccaauucaagauuccccauuccuuuggaaaaauuguuuacgggucccagcagugccuuuguuguucaaccacaaaauggcagaugcacgacugauggcgugcucuuaggcaccacacaacugucuccugucaacaucugcaccuucagaggggaugucacccacauugcagguucucauaauuacacaaugaauuuggccucucuaaauuggaacaauuaugacccaacagaagaaauuccagccccucuaggaaccccagauuucgugggaaagauccaaggugugcucacucaaaccacaaagggagaugguucgacccguggccauaaagcuacaguuuacacugggagugcccccuuuacuccaaagcuaggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguccaaaauguacaccuagccccugcuguagcccccacguuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaagcuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5666 - RNA, 1623 nt, Artificial Sequence
  VP1__Norovirus__BAS30110
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccaggauguauaaugguuaugcaggugguuuugaagugcaggugauccucgcggggaacgcguucaccgccggaaaaauuauauuugcagcagucccaccaaauuuuccaauugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaauguuguauacaccacuuagggcuaauaaugcuggggaagaugucuuuacagucucuugucgaguucucacgaggccauccccugauuuugauuuuauauuuuuggugccaccuacaguugagucaagaacuaaaccauucacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuacgacccaacagaagaaauuccagccccucuaggaaccccagauuucgugggaaagauucagggagugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuucagguccacuaugcccggaugcagcggguaucccaacauggauuuggauugccugcucccccaggagugggugcagcacuucuaccaagaggcagcuccagcacaaucugauguggcucuauugagauuugugaauccagacacggguaggguccuguuugagugcaagcuucacaaaucaggcuaugucacaguggcucacaccggccagcaugauuuggucaucccccccaaugguuauuuuagguuugauuccuggguuaaucaguucuacacacuugcccccaugggaaauggaacggggcguagacgugcuuuauaa

SEQ ID NO: 5667 - RNA, 1623 nt, Artificial Sequence
  VP1__Norovirus__BAS30113
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugauuugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaauguuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaaccccagauuucgugggaaagauccaaggagugcucacucaaaccacgaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccugcucccccaggagugggugcagcacuucuaccaagaggcagcuccagcacaaucugauguggcacuauugagauuugugaauccagacacggguaggguccuguuugagugcaagcuucacaaaucaggcuaugucacaguggcucacaccggccagcaugaucuggucaucccccccaaugguuauuuuagguuugauuccuggguuaaucaguucuacacacuugcccccaugggaaauggaacggggcguagacgugcuuuauaa

SEQ ID NO: 5668 - RNA, 1623 nt, Artificial Sequence
  VP1__Norovirus__BAS30116
augaagauggcgucuaaugacgccaacccaucugauggguccgcagccaaccucgucccagaggucaacaaugagguuauggcucuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaacuucccaacugaaggccugagucccagccagguuacuauguucccccacauaauaguggauguuaggcaauuggaaccuguauugauccccuuaccugauguuaggaauaacuuuuaucauuauaaucagucaaaugauucuaccauuaaauugauagcaaugcuguauacaccacuuagggcuaauaaugcuggggaagaugucuucacaguuucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggccccagcagugccuuuguuguucaaccacaaaauggcagaugcacgacugauggcgugcucuuaggcaccacccaacugucuccugucaacaucugcaccuucagaggggaugucacccacauugcagguucucgugauuacacaaugaauuuggcuucucuaaauuggaacaauuaugacccaacagaagaaauuccagccccuuuaggaaccccagauuucgugggaaagauccaagguaugcucacucaaacuacaaagggagauggcucgacccguggccauaaagcuacaguuuacacugggagugcccccuuuacuccaaagcugggcaguguucgguucaguacugacacagaaaaugauuuugaaauucaccaaaauacaaaauucacuccagucggugucauccaggaugguagcaccacccaccgaaaugaaccccaacaauggguacucccaaguuauucagguagagaugcccauaauguacaccuagccccugcuguagcccccacuuuuccgggugaacaacuucuuuucuucagguccacuaugcccggaugcagcggguaucccaacauggauuuggauugccugcucccccaggagugggugcagcacuucuaccaagaggcagcuccagcacaaucugauguggcucuauugagauuugugaauccagacacggguaggguucuguuugagugcaaacuccauaaaucaggcuaugucacaguggcucacaccggccagcaugauuuggucaucccccccaaugguuauuuuagguuugauuccuggguuaaucaauucuauacacuugcccccaugggaaauggaacggggcguagacgugcuuuauaa

SEQ ID NO: 5669 - RNA, 1623 nt, Artificial Sequence
  VP1__Norovirus__BAS30119
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaggugcaggugauccucgcggggaacgcguucaccgccggaaaaauuauauuugcagcagucccaccaaauuuuccaauugaaggcuugagucccagccaggucacuauguucccccacauaauaguggauguuaggcaauuggaaccuguguugauccccuuaccugauguuaggaauaacuuuuaucacuauaaucagucaaaugauucuaccauuaaauugauagcaauguuguacacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuauacaaugaauuuggcuucucuaaauuggaacaauuaugacccaacagaagaaauuccagccccucuaggaaccccagauuucgugggaaagauucaaggagugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuucagguccacuaugcccggaugcagcggguaucccaacauggauuuggauugccugcucccccaggagugggugcagcacuucuaccaagaggcagcuccagcacaaucugauguggcucuauugagauuugugaauccagacacggguaggguccuguuugagugcaagcuucacaaaucaggcuaugucacaguggcucacaccggccagcaugauuuggucaucccccccaaugguuauuuuagguuugauuccuggguuaaucaguucuacacacuugcccccaugggaaauggaacggggcguagacgugcuuuauaa

SEQ ID NO: 5670 - RNA, 1623 nt, Artificial Sequence
  VP1__Norovirus__BAS30125
augaagauggcgucgaaugacgccaacccaucugauggguccgcagccaaccucgucccagaggucaacaaugagguuauggcucuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggccagaauguauaaugguuaugcaggugguuuugaagugcaggugauccucgcggggaacgcguucaccgccggaaaaauuauauuugcagcagucccaccaaacuucccaacugaaggccugagucccagccagguuacuauguucccccacauaauaguggauguuaggcaauuggaaccuguauugauccccuuaccugauguuaggaauaacuuuuaucauuauaaucagucaaaugauucuaccauuaaauugauagcaaugcuguauacaccacuuagggcuaauaaugcuggggaagaugucuucacaguuucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggccccagcagugccuuuguuguucaaccacaaaauggcagaugcacgacugauggcgugcucuuaggcaccacccaacugucuccugucaacaucugcaccuucagaggggaugucacccacauugcagguucucgugauuacacaaugaauuuggcuucucuaaauuggaacaauuaugacccaacagaagaaauuccagccccuuuaggaaccccagauuucgugggaaagauccaagguaugcucacucaaaccacaaagggagauggcucgacccguggccauaaagcuacaguuuacacugggagugcccccuuuacuccaaagcugggcaguguucgguucaguacugacacagaaaaugauuuugaaauucaccaaaauacaaaauucacuccagucggugucauccaggaugguagcaccacccaccgaaaugaaccccaacaauggguacucccaaguuauucagguagagaugcccauaauguacaccuagccccugcuguagcccccacuuuuccgggugaacaacuucuuuucuucagguccacuaugcccggaugcagcggguaucccaacauggauuuggauugccugcucccccaggagugggugcagcacuucuaccaagaggcagcuccagcacaaucugauguggcucuauugagauuugugaauccagacacggguaggguucuguuugagugcaaacuccauaaaucaggcuaugucacaguggcucacaccggccagcaugauuuggucaucccccccaaugguuauuuuagguuugauuccuggguuaaucaauucuauacacuugcccccaugggaaauggaacggggcguagacguguuuuauaa

SEQ ID NO: 5671 - RNA, 1623 nt, Artificial Sequence
  VP1__Norovirus__BAS30128
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugagucccagccaggucacuauguucccccacauaauaguggauguuaggcaauuggaaccuguguugaucccccuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugacuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggccucucuaaauuggaacaauuaugacccaacagaagaaauuccagccccucuaggaacuccagauuuugugggaaagauccaaggugugcucacucaaaccacaaagggagauggcucgacccguggccauaaagcuacaguuuacacugggagugcccccuuuacuccaaagcugggcaguguccaauucaguacugauacagagaaugauuuugaaacucaccaaaacacaaaguucaccccagucggugucauccaggaugguggcaccacccaucgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccuacucccccaggagugggugcagcacuucuaccaagaagcagcuccggcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauuuuacacacuugcccccaugggaaauggaacggggcguagacgugcuuuauaa

SEQ ID NO: 5672 - RNA, 1623 nt, Artificial Sequence
  VP1__Norovirus__BAS30134
augaagauggcgucuaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcacccuuaggcccugaucugaaucccuaccuaucucauuuggccagaauguauaaugguuacgcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucauuauaaucaaucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauucacugucccaaucuuaacuguugaggaaaugaccaauucaagauuccccauuccuuuggaaaaguuguucacggguccuagcagugccuuuguuguccaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaacuggaacaauuaugacccaacagaagaaauuccagccccucuaggaacuccggauuucgugggaaagauccaagguaugcucacucaaaccacaaaaggagaugguucgacccguggccauaaagccacaguuuacacugggagugcccccuuuacuccaaagcugggcaguguucaauucaguacugauacagaaaaugauuuugaaacccaccaaaacacaaaauucaccccagucggugucauccaggaugguagcaccacccaccgaaaugaaccccaacaaugggugcucccaaguuauucagguagagaugucccuaauguacaccuagccccugcuguagcucccacuuucccgggugaacaacuccuuuucuuuaggucuacuaugcccggaugcagcggguaucccaacauggauuuggauugccuacucccccaggaguggguucagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5673 - RNA, 1623 nt, Artificial Sequence
  VP1__Norovirus__BAS30137
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugagucccagccaggucacuauguucccccacauaauaguggauguuaggcaauuggaaccuguguugaucccccuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggccucucuaaauuggaacaauuaugacccaacagaagaaauuccagccccucuaggaacuccagauuuugugggaaagauccaaggugugcucacucaaaccacaaagggagauggcucgacccguggccauaaagcuacaguuuacacugggagugcccccuuuacuccaaagcugggcaguguccaauucaguacugauacagagaaugauuuugaaacucaccaaaacacaaaguucaccccagucggugucauccaggaugguggcaccacccaucgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccuacucccccaggagugggugcagcacuucuaccaagaagcagcuccggcacaaucugauguggcucuauugagauuuguaaauccagacacggguaggguccuguuugagugcaaacuucauaaaucaggcuaugucacaguggcucacaccggccagcaugauuuggucaucccccccaaugguuauuuuagguuugauuccuggguuaaucaauuuuacacacuugcccccaugggaaauggaacggggcguagacgugcuuuauaa

SEQ ID NO: 5674 - RNA, 1623 nt, Artificial Sequence
  VP1__Norovirus__BAS30140
augaagauggcgucuaaugacgccaacccaucugauggguccgcagccaaccucgucccagaggucaacaaugagguuauggcuuuggagcccguugucggugccgcuauugcggcgccuguagcgggccaacaaaauguaauugaccccuggauuaggaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccauauaauaguagauguuaggcaauuggaaccuguguugauccccuuaccugauguuaggaauaauuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuucauauuuuuggugccaccuacaguugagucaagaacuaaaccauuuacugucccaaucuuaacuguugaagaaaugaccaacucaagauuccccauuccuuuggagaaguuguucacgggucccaguagugccuuuguuguucaaccacaaaauggcagaugcacaacugauggcgugcucuuaggcaccacccagcugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagcgcccccuucacuccaaagcugggcaguguccaauucaguacugauacagaaaaugauuuugaaacccaccaaaacacaaaauucaccccagucggugucauccaggaugguggcaccacccaccgaaaugaaccucaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccuacuaccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaaugguuauuuuagguuugauuccuggguuaaucaauucuacacgcuugcccccaugggaaauggaacggggcguagacgugcuuuauaa

SEQ ID NO: 5675 - RNA, 1623 nt, Artificial Sequence
  VP1__Norovirus__BAS30146
augaagauggcgucuaacgacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuguggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaauugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcuuuuaggcaccacccaacugucuccugucaacaucugcaccuucagaggggaugucacccacauugcagguucucauaauuacacaaugaguuuggcuucucuaaauuggaacaauuaugacccaacagaagaaauuccagccccucuaggaaccccagauuucgugggaaagauucaaggagugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuacucagguagaaaugucccuaauguacaccuagccccugcuguagcccccacuuuuccgggugaacaacuucuuuucuucagguccacuaugcccggaugcagcggguaucccaacauggauuuggauugccugcucccccaggagugggugcagcacuucuaccaagaggcagcuccagcacaaucugauguggcucuauugagauuugugaauccagacacggguaggguccuguuugagugcaagcuucacaagucaggcuaugucacaguggcucacaccggccagcaugauuuggucaucccccccaaugguuauuuuagguuugauuccuggguuaaucaguucuacacacuugcccccaugggaaauggaacggggcguagacgugcuuuauaa

SEQ ID NO: 5676 - RNA, 1623 nt, Artificial Sequence
  VP1__Norovirus__BAS30149
augaagauggcgucuaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaauuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuucauauuuuuggugccaccuacaguugagucaagaacuaaaccauuuacugucccaaucuuaacuguugaagaaaugaccaacucaagauuccccaucccuuuggagaaguuguucacaggucccagcagugccuuuguuguucaaccacaaaauggcagaugcacaacugauggcgugcucuuaggcaccacccagcugucuccugucaacaucugcaccuucagaggggaugucacccacauugcagguucucguaauuacacaaugaauuuagcuucucuaaauuggaacaauuaugacccaacagaagaaauuccagccccucuaggaacuccagauuucguggggaagauccaaggugugcucacucaaaccacaaagggagauggcucgacccguggccauaaagcuacaguuuacacugggagugcccccuucacuccaaagcugggcaguguccaauucaguacugauacagaaaaugauuuugaaacccaccaaaacacaaaauucaccccagucggugucauccaggaugguagcaccacccaccgaaaugaaccucaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccuacuaccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuugguuaucccccccaaugguuauuuuagguuugacuccuggguuaaucaauucuacacgcuugcccccaugggaaauggaacggggcguagacgugcuuuauaa

SEQ ID NO: 5677 - RNA, 1623 nt, Artificial Sequence
  VP1__Norovirus__BAS30152
augaagauggcgucuaacgacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggcuagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaauuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuucauauuuuuggugccaccuacaguugagucaagaacuaaaccauuuacugucccaaucuuaacuguugaagaaaugaccaacucaagauuccccaucccuuuggagaaguuguucacaggucccagcagugccuuuguuguucaaccacaaaauggcagaugcacaacugauggcgugcucuuaggcaccacccagcugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuucacuccaaagcugggcaguguccaauucaguacugauacagaaaaugauuuugaaacccaccaaaacacaaaauucaccccagucggugucauccaggaugguggcaccacccaccgaaaugaaccucaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccuacuaccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaaugguuauuuuagguuugacuccuggguuaaucaauucuacacgcuugcccccaugggaaauggaacggggcguagacgugcuuuauaa

SEQ ID NO: 5678 - RNA, 1623 nt, Artificial Sequence
  VP1__Norovirus__BAS30155
augaagauggcgucuaacgacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugauuugaaccccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccauauaauaguggauguuaggcaauuggaaccuguguugauccccuuaccugauguuaggaauaauuucuaucauuauaaucagucaaaugauucuacuauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggagaaauuguucacgggucccagcggugccuuuguuguucaaccgcaaaauggcagaugcacgacugauggcgugcuccuaggcaccacccaacugucuccugucaacauuugcaccuucaaaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagaugguucgacccguggccacaaagcuacagucuacacugggagugcucccuuuacuccaaagcugggcaguguucaauucaguacugauacagaaaaugauuuugaaacucaccaaaacacaaaauucaccccagucggugucauccaggaugguggcaccacccaucaaaaugaaccccaacaaugggugcucccaaguuauucagguagagaugucccuaauguacaccuagccccugcuguggcccccacuuucccgggugaacaacuucuuuucuuuagguccaccaugcccggaugcagcggguaucccaacaugaauuuggacugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcucacaccggccagcaugaucuggucaucccccccaaugguuauuuuagguuugauuccuggguuaaucaauucuacacacucgcccccaugggaaauggaacggggcguagacgugcuuuauaa

SEQ ID NO: 5679 - RNA, 1623 nt, Artificial Sequence
  VP1__Norovirus__BAS30158
augaagauggcgucuaacgacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccgggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaauugaaggcuugagucccagccaggucacuauguucccccacauaauaguggauguuaggcaauuggaaccuguguugauccccuuaccugauguuaggaauaacuucuaucauuacaaucaguuaaaugauucuaccauuaaauugauagcaauguuguauacgccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaguuuggcuucucuaaauuggaacaauuaugacccaacagaagaaauuccagccccucuaggaaccccagauuucgugggaaagauucaaggagugcucacucaaaccacaaagggagauggcucgacccgcggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaucuagccccugcuguagcccccacuuuuccgggugaacaacuucuuuucuucagguccacuaugcccggaugcagcggguaccccaacauggauuuggauugccugcucccccaggagugggugcagcacuucuaccaagaggcagcuccagcacaaucugauguggcucuauugagauuugugaauccagacacggguaggguccuguuugagugcaagcuucacaagucaggcuaugucacaguggcucacaccggccagcaugauuuggucaucccccccaaugguuauuuuagguuugauuccuggguuaaucaguucuacacacuugcccccaugggaaauggaacggggcguagacgugcuuuauaa

SEQ ID NO: 5680 - RNA, 1623 nt, Artificial Sequence
  VP1__Norovirus__BAS30164
augaagauggcgucuaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccgggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaauugaaggcuugagucccagccaggucacuauguucccccacauaauaguggauguuaggcaauuggaaccuguguugauccccuuaccugauguuaggaauaacuucuaucacuacaaucagucaaaugauucuaccauuaaauugauagcaauguuguauacgccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaguuuggcuucucuaaauuggaacaauuaugacccaacagaagaaauuccagccccucuaggaaccccagauuucgugggaaagauucaaggagugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaucuagccccugcuguagcccccacuuuuccgggugaacaacuucuuuucuucagguccacuaugcccggaugcagcggguaccccaacauggauuuggauugccugcucccccaggagugggugcagcacuucuaccaagaggcagcuccagcacaaucugauguggcucuauugagauuugugaauccugacacggguaggguccuguuugagugcaagcuucacaagucaggcuaugucacaguggcucacaccggccagcaugauuuggucaucccccccaaugguuauuuuagguuugauuccuggguuaaucaguucuacacacuugcccccaugggaaauggaacggggcguagacgugcuuuauaa

SEQ ID NO: 5681 - RNA, 1623 nt, Artificial Sequence
  VP1__Norovirus__BAS30167
augaagauggcgucuaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccgggugaaauacuauggagcgcgcccuuaggcccugaucugaaucccuaccuaucucauuuggccagaauguauaaugguuaugcaggugguuuugaagugcaggugauucucgcggggaacgcguucaccgccggaaaaauuauauuugcagcaguuccaccaaauuuuccaacugaaggcuugagucccagccaggucacuauguucccccauauaauaguggauguuaggcaauuggaaccuguguugauccccuuaccugauguuaggaauaacuucuaccacuauaaucagucaaaugacucuaccauuaaauugauagcaaugcuguauacaccacuuagggcuaauaaugcuggggaagauguuuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggccccagcagcgccuuuguuguucaaccacaaaauggcagaugcacgacugauggugugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuuugugggaaagauccagggugugcucacccaaaccacaaagggagaugguucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaaugucccuaauguacaccuagccccugcuguagcccccacuuucccgggugaacaacuucuuuucuuuaggucuacuaugcccggaugcagcggguaucccaacauggauuuggauugccuacucccucaggagugggugcagcacuucuaucaagaggcagcuccagcacaaucugauguggcucuauugagguuugugaacccagacacggguaggguccuauuugaguguaaacuucauaaaucagguuaugucacaguggcucacaccggccagcaugauuuggucaucccccccaauggcuauuuuagguuugauuccuggguuaaucaauucuacacacuugcccccaugggaaauggaacggggcguagacgugccuuauaa

SEQ ID NO: 5682 - RNA, 1623 nt, Artificial Sequence
  VP1__Norovirus__BAS30170
augaagauggcgucuaacgacgccaacccaucugauggguccgcagccaaccucgucccagaggucaacaaugagguuauggcuuuggagcccguugucggugccgcuauugcggcgcccguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucacuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccauauaauaguggauguuaggcaauuggaaccuguguugaucccccuaccugauguuaggaauaacuucuaucacuauaaccagucaaaugauucuaccauuaaauugauagcaaugcuguauacaccacuuagggcuaauaaugcuggggaagaugucuuuacagucucuugucgaguucucacgaggccauccccugauuuugauuuuauauucuuagugccaccuacaguugagucaagaacuaaaccauuuacugucccaaucuuaacuguugaagaaaugaccaauucaagauuccccauuccuuuggaaaaauuguucacgggucccagcagugccuuuguuguccaaccacaaaauggcagaugcacgacugauggcgugcucuuaggcaccacccaacugucuccugucaacauuugcaccuucagaggggaugucacccacauugcagguucucguaauuacacaaugaauuuggccucucuaaauuggaacaauuaugacccaacagaagaaaucccagccccucuagggacuccagacuucgugggaaagauucaaggugugcucacucaaaccacaaagggagauggcucgacccguggccauaaagcuacaguuuacacugggagugcccccuuuacuccaaagcuggguaguguucaauucaguacugauacagagaaugauuuugaaacucaccaaaauacaaaauucaccccagucggugucauccaggaugguggcaccacccaccgaaaugaaccccaacaaugggugcucccaaguuauucagguaggaaugucccuaauguacaccuagccccugcuguagcccccacuuuuccgggugaacagcuucuuuucuuuagguccacuaugcccggauguagcggguaccccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugacuccuggguuaaucaauucuacacgcuugcccccaugggaaauggaacggggcguagacgugcuuuauaa

SEQ ID NO: 5683 - RNA, 1623 nt, Artificial Sequence
  VP1__Norovirus__BAS30173
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucacuuggccagaauguauaaugguuaugcaggugguuuugaagugcaggugauccucgcggggaacgcguucaccgccgggaaaauuauauuugcagcagucccaccaaauuuuccaacugaaggcuugagucccagccaggucacuauguucccccacauaauaguggauguuaggcaauuggaaccuguguugaucccccuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagguuccccauuccuuuggaaaaauuguucacggguccuagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggccucucuaaauuggaacaauuaugacccaacagaagaaauuccagccccucuaggaacuccagauuuugugggaaagauccaaggugugcucacucaaaccacaaagggagauggcucgacccguggccauaaagcuacagucuacacugggagugcccccuuuacuccaaagcugggcaguguccaauucaguacugauacagagaaugauuuugaaacucaccaaaacacaaaguucaccccagucggugucauccaggaugguggcaccacccaucgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccuacucccccaggagugggugcagcacuucuaccaagaagcagcuccggcacaaucugauguggcucuauugagauuuguaaauccagacacggguaggguccuguuugagugcaaacuucauaaaucaggcuaugucacaguggcucacaccggccaguaugauuuggucaucccccccaaugguuauuuuagguuugauuccugggucaaucaauuuuacacacuugcccccaugggaaauggaacggggcguagacgugcuuuauaa

SEQ ID NO: 5684 - RNA, 1623 nt, Artificial Sequence
  VP1__Norovirus__BAS30176
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaacccuauggagcgcgcccuuaggcccugaucugaaucccuaccuaucucacuuggccagaauguauaaugguuaugcaggugguuuugaagugcaggugauucucgcggggaacgcguucaccgccggaaaaauuauauuugcagcaguuccaccaaauuuuccaacugaaggcuugagucccagccaggucacuauguucccccauauaauaguggauguuaggcaauuggaaccuguguugauccccuuaccugauguuaggaauaacuucuaccacuauaaucagucaaaugacucuaccauuaaauugauagcaaugcuguauacaccacuuagggcuaauaaugcuggggaagauguuuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggccccagcagcgccuuuguuguucaaccacaaaauggcagaugcacgacugauggugugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuuugugggaaagauccaggguaugcucacccaaaccacaaagggagaugguucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguagcaccacccaccgaaaugaaccccaacaaugggugcucccaaguuauucagguagaaaugucccuaauguacaccuagccccugcuguagcccccacuuucccgggugaacaacuucuuuucuuuaggucuacuaugcccggaugcagcggguaucccaacauggauuuggauugccuacucccucaggagugggugcagcacuucuaccaagaggcagcuccagcacaaucugauguggcucuauugagguuugugaacccagacacggguaggguccuauuugaguguaaacuucauaaaucagguuaugucacaguggcucacacuggccagcaugauuuggucaucccccccaaugguuauuuuagguuugauuccuggguuaaucaauucuacacacuugcccccaugggaaauggaacggggcguagacgugccuuauaa

SEQ ID NO: 5685 - RNA, 1623 nt, Artificial Sequence
  VP1__Norovirus__BAS30179
augaagauggcgucuaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccgggugaaauacuauggagcgcgcccuuaggcccugaucugaaucccuaccuaucucauuuggccagaauguauaaugguuaugcaggugguuuugaagugcaggugauucucgcggggaacgcguucaccgcgggaaaaauuauauuugcagcaguuccaccaaauuuuccaacugaaggcuugagucccagccaggucacuauguucccccauauaauaguggauguuaggcaauuggaaccuguguugauccccuuaccugauguuaggaauaacuucuaccacuauaaucagucaaaugacucuaccauuaaauugauagcaaugcuguauacaccacuuagggcuaauaaugcuggggaagauguuuuuacagucucuugucgaguucucacgaggccauccccugauuuugauuuuauauuuuugguaccaccuacaguugagucaagaacuaaaccauuuacugucccaaucuuaacuguugaagaaaugaccaauucaagauuccccauuccuuuggaaaaauuguucacgggccccagcagcgccuuuguuguucaaccacaaaauggcagaugcacgacugaugguuugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuuugugggaaagauccaggguaugcucacccaaaccacaaagggagaugguucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguagcaccacccaccgaaaugaaccccaacaaugggugcucccaaguuauucagguagaaaugucccuaauguacaccuagccccugcuguagcccccacuuucccgggugaacaacuucuuuucuuuaggucuacuaugcccggaugcagcggguaucccaacauggauuuggauugccuacucccucaggagugggugcagcacuucuaccaagaggcagcuccagcacaaucugauguggcucuauugagguuugugaacccagacacggguaggguccuauuugaguguaaacuucauaaaucagguuaugucacaguggcucacaccggccagcaugauuuggucaucccccccaaugguuauuuuagguuugauuccuggguuaaucaauucuacacacuugcccccaugggaaauggaacggggcguagacgugccuuauaa

SEQ ID NO: 5686 - RNA, 1623 nt, Artificial Sequence
  VP1__Norovirus__BAS30182
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccgggugaaauacuauggagcgcgcccuuaggcccugaucugaaucccuaccugucucauuuggccagaauguauaaugguuaugcaggugguuuugaagugcaggugauucucgcggggaacgcguucaccgccggaaaaauuauauuugcagcaguuccaccaaauuuuccaacugaaggcuugagucccagucaggucacuauguucccccauauaauaguggauguuaggcaauuggaaccuguguugauccccuuaccugauguuaggaauaacuucuaccacuauaaucagucaaaugacucuaccauuaaauugauagcaaugcuguauacaccacuuagggcuaauaaugcuggggaagauguuuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggccccagcagcgccuuuguuguucaaccacaaaauggcagaugcacgacugauggugugcucuuaggcaccacccaacugucuccugucaacaucugcaccuucagaggggaugucacccacauugcagguucucgugauuacacaaugaauuuggcuucucuaaauuggaacaauuaugacccaacagaagaaauuccagccccucuaggaacuccagauuuugugggaaagauccaggguaugcucacccaaaccacaaagggagaugguucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguagcaccacccaccgaaaugaaccccaacaaugggugcucccaaguuauucagguagaaaugucccuaauguacaccuagccccugcuguagcccccacuuucccgggugaacaacuucuuuucuuuaggucuacuaugcccgggugcagcggguaucccaacauggauuuggauugccuacucccucaggagugggugcagcacuucuaccaagaggcagcuccagcacaaucugauguggcucuauugagguuugugaacccagacacggguaggguccuauuugaguguaaacuucauaaaucagguuaugucacaguggcucacaccggccagcaugauuuggucaucccccccaaugguuauuuuagguuugauuccuggguuaaucaauucuacacacuugcccccaugggaaauggaacggggcguagacgugccuuauaa

SEQ ID NO: 5687 - RNA, 1623 nt, Artificial Sequence
  VP1__Norovirus__BAS30185
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaaucuuauggagcgcgcccuuaggcccugaucugaaucccuaccugucucauuuggccagaauguauaaugguuaugcaggugguuuugaagugcaggugauucucgcggggaacgcguucaccgccggaaaaauuauauuugcagcaguuccaccaaauuuuccaacugaaggcuugagucccagccaggucacuauguucccccauauaauaguggauguuaggcaauuggaaccuguguugauccccuuaccugauguuaggaauaacuucuaccacuauaaucagucaaaugacucuaccauuaaauugauagcaaugcuguauacaccacuuagggcuaauaaugcuggggaagauguuuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggccccagcagcgccuuuguuguucaaccacaaaauggcagaugcacgacugauggugugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuuugugggaaagauccaggguaugcucacccaaaccacaaagggagaugguucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguagcaccacccaccgaaaugaaccccaacaaugggugcucccaaguuauucagguagaaaugucccuaauguacaccuagccccugcuguagcccccacuuucccgggugaacaacuucuuuucuuuaggucuacuaugcccggaugcagcggguaucccaacauggauuuggauugccuacucccucaggagugggugcagcacuucuaccaagaggcagcuccagcacaaucugauguggcucuauugagguuugugaacccagacacggguaggguccuauuugaguguaaacuucauaaaucagguuaugucacaguggcucacaccggccagcaugauuuggucaucccccccaaugguuauuuuagguuugauuccuggguuaaucaauucuacacacuugcccccaugggaaauggaacggggcguagacgugccuuauaa

SEQ ID NO: 5688 - RNA, 1623 nt, Artificial Sequence
  VP1__Norovirus__BAS30188
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccugucucauuuggccagaauguauaaugguuaugcaggugguuuugaagugcaggugauucucgcggggaaugcguucaccgccggaaaaauuauauuugcagcaguuccaccaaauuuuccaacugaaggcuugagucccagccaggucacuauguucccccauauaauaguggauguuaggcaauuggaaccuguguugauccccuuaccugauguuaggaauaacuucuaccacuauaaucagucaaaugacucuaccauuaaauugauagcaaugcuguauacaccacuuagggcuaauaaugcuggggaagauguuuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggccccagcagcgccuuuguuguucaaccacagaauggcagaugcacgacugauggugugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuuugugggaaagauccaggguaugcucacccaaaccacaaagggagaugguucgacccguggccauaaagcuacaguuuacacugggagugcccccuuuacuccaaagcugggcaguguucaauucaguacugacacagaaaaugauuuugaaacucaccaaaacacaaaauucaccccagucggugucauccacgaugguagcaccacccaccgaaaugaaccccaacaaugggugcucccaaguuauucagguagaaaugucccuaauguacaccuagccccugcuguagcccccacuuucccgggugaacaacuucuuuucuuuaggucuacuaugcccggaugcagcggguaucccaacauggauuuggauugccuacucccucaggagugggugcagcacuucuaccaagaggcagcuccagcacaaucugauguggcucuauugagguuugugaacccagacacggguaggguccuauuugaguguaaacuucauaaaucagguuaugucacaguggcucacaccggccagcaugauuuggucaucccccccaaugguuauuuuagguuugauuccuggguuaaucaauucuacacacuugcccccaugggaaauggaacggggcguagacgugccuuauaa

SEQ ID NO: 5689 - RNA, 1623 nt, Artificial Sequence
  VP1__Norovirus__BAS30191
augaagauggcgucuaacgacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccagguuacuauguucccccauauaauaguggauguuaggcaauuggaaccuguguugauccccuuaccugauguuaggaauaacuucuaucauuauaaucagucaaaugauucuaccauuaaauugauagcaauguuguauacaccacuuagggcuaauaaugcuggggaagaugucuucacagucucuugucgaguucucacgaggccauccccugauuuugauuuuauauucuuggugccaccuacaguugagucaagaacuaaaccauuuacugucccaaucuuaacuguugaagaaaugaccaauucaagauuccccauuccuuuggaaaaauuguuuacgggucccagcagugccuuuguuguucaaccacaaaauggcagaugcacgacugauggcgugcucuuaggcaccacccaacuguccccugucaacaucugcaccuucagaggggaugucacccacaucgcagguucucguaauuauacaaugaauuuggcuucucuaaauuggaacaauuaugacccaacagaagaaauuccagccccccuaggaacuccagauuucgugggaaagauccaaggugugcucacucaaaccacaaagggagauggcucgacccgcggccauaaagcuacaguuuacacugggagugcccccuucacuccaaagcugggcaguguucaauucgguacugauacagaaaaugauuuugaaacccaccaaaacacaaaauucaccccagucggugucauccaggaugguggcaccacccaccgaaaugaaccccaacaaugggugcucccaaguuauucagguagaaaugucccuaauguacaccuagcccccgcuguagcccccacuuuuccaggugaacaacuucuuuucuuuagguccacuaugcccggaugcagcggguaucccaacauggauuuggauugccugcucccccaggagugggugcagcacuuuuaccaagaggcagcuccagcacaaucugauguggcucuauugagauuugugaauccagacacggguaggguucuuuuugagugcaaacuucacaaaucaggcuaugucacaguggcucacaccggccagcaugauuuggucaucccccccaauggcuauuuuagguuugauuccuggguuaaucaguucuacacacuugcccccaugggaaauggaacggggcguagacgugcuuuauaa

SEQ ID NO: 5690 - RNA, 1623 nt, Artificial Sequence
  VP1__Norovirus__BAS30194
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccagguuacuauguucccccauauaauaguggauguuaggcaauuggaaccuguguugauccccuuaccugauguuaggaauaacuucuaucauuauaaucagucaaaugauucuaccauuaaauugauagcaauguuguauacaccacuuagggcuaauaaugcuggggaagaugucuucacagucucuugucgaguucucacgaggccauccccugauuuugauuuuauauucuuggugccaccuacaguugagucaagaacuaaaccauuuacugucccaaucuuaacuguugaagaaaugaccaauucaagauuccccauuccuuuggaaaaauuguuuacgggucccagcagugccuuuguuguucaaccacaaaauggcagaugcacgacugauggcgugcucuuaggcaccacccaacuguccccugucaacaucugcaccuucagaggggaugucacccacaucgcagguucucguaauuauacaaugaauuuggcuucucuaaauuggaacaauuaugacccaacagaagaaauuccagccccccuaggaacuccagauuucgugggaaagauccaaggugugcucacucaaaccacaaagggagauggcucgacccgcggccauaaagcuacaguuuacacugggagugcccccuucacuccaaagcugggcaguguucaauucgguacugauacagaaaaugauuuugaaacccaccaaaacacaaaauucaccccagucggugucauccaggaugguggcaccacccaccgaaaugaaccccaacaaugggugcucccaaguuauucagguagaaaugucccuaauguacaccuagcccccgcuguagcccccacuuuuccaggugaacaacuucuuuucuuuagguccacuaugcccggaugcagcggguaucccaacauggauuuggauugccugcucccccaggagugggugcagcacuuuuaccaagaggcagcuccagcacaaucugauguggcucuauugagauuugugaauccagacacggguaggguucuuuuugagugcaaacuucacaaaucaggcuaugucacaguggcucacaccggccagcaugauuuggucaucccccccaauggcuauuuuagguuugauuccuggguuaaucaguucuacacacuugcccccaugggaaauggaacggggcguagacgugcuuuauaa

SEQ ID NO: 5691 - RNA, 1623 nt, Artificial Sequence; identical to SEQ ID NO: 5690
  VP1__Norovirus__BAS30197

SEQ ID NO: 5692 - RNA, 1623 nt, Artificial Sequence; identical to SEQ ID NO: 5690
  VP1__Norovirus__BAS30200

SEQ ID NO: 5693 - RNA, 1623 nt, Artificial Sequence
  VP1__Norovirus__BAS30203
augaagauggcgucgaaugacgccaacccaucugauggguccgcagccaaccucgucccagaggucaacaaugagguuauggcuuuggagcccguugucggugccgcuauugcggcgccuguggcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccauauaauaguggauguuaggcaauuggaaccuguguugauccccuuaccugauguuaggaauaacuucuaucauuauaaucagucaaaugauucuaccauuaaauugauagcaauguuguauacaccacuuagggcuaauaaugcuggggaagaugucuuuacagucucuugucgaguucucacgaggccauccccugauuuugauuuuauauucuuggugccaccuacaguugagucaagaacuaaaccauuuacugucccaaucuuaacuguugaagaaaugaccaauucaagauuccccauuccuuuggaaaaauuguuuacgggucccagcagugccuuuguuguucaaccacaaaauggcagaugcacgacugauggcgugcucuuaggcaccacccaacuguccccugucaacaucugcaccuucagaggggaugucacccacauugcagguucucguaauuauacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuucacuccaaagcugggcaguguucaauucgguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccaggugaacaacuucuuuucuuuagguccacuaugcccggauguagcggguaucccaacauggauuuggauugccugcucccccaggagugggugcagcacuuuuaccaagaggcagcuccagcacaaucugauguggcucuauugagauuugugaauccagacacggguaggguucuguuugagugcaaacuucacaaaucaggcuaugucacaguggcucacaccggccagcaugauuuggucaucccccccaauggcuauuuuagguuugauuccuggguuaaucaguucuacacacuugcccccaugggaaauggaacggggcguagacgugcuuuauaa

SEQ ID NO: 5694 - RNA, 1623 nt, Artificial Sequence
  VP1__Norovirus__BAS30206
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccagguuacuauguucccccauauaauaguggauguuaggcaauuggaaccuguguugauccccuuaccugauguuaggaauaacuucuaucauuauaaucagucaaaugauucuaccauuaaauugauagcaauguuguauacaccacuuagggcuaauaaugcuggggaagaugucuuuacagucucuugucgaguucucacgaggccauccccugauuuugauuuuauauucuuggugccaccuacaguugagucaagaacuaaaccauuuacugucccaaucuuaacuguugaagaaaugaccaauucaagauuccccauuccuuuggaaaaauuguuuacgggucccagcagugccuuuguuguucaaccacaaaauggcagaugcacgacugauggcgugcucuuaggcaccacccaacuguccccugucaacaucugcaccuucagaggggaugucacccacauugcagguucucguaauuauacaaugaauuuggcuucucuaaauuggaacaauuaugacccaacagaagaaauuccagccccucuaggaacuccagauuucgugggaaagauccaaggugugcucacucaaaccacaaagggagauggcucgacccgcggccauaaagcuacaguuuacacugggagugcccccuucacuccaaagcugggcaguguucaauucgguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagcccccgcuguagcccccacuuuuccaggugaacaacuucuuuucuuuagguccacuaugcccggaugcagcggguaucccaacauggauuuggauugccugcucccccaggagugggugcagcacuuuuaccaagaggcagcuccagcacaaucugauguggcucuauugagauuugugaauccagacacggguaggguucuuuuugagugcaaacuucacaaaucaggcuaugucacaguggcucacaccggccagcaugauuuggucaucccccccaauggcuauuuuagguuugauuccuggguuaaucaguucuacacacuugcccccaugggaaauggaacggggcguagacgugcuuuauaa

SEQ ID NO: 5695 - RNA, 1623 nt, Artificial Sequence
  VP1__Norovirus__BAS30209
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcacccuuaggcccugaucugaaucccuaccuaucucauuuggccagaauguauaaugguuaugcaggugguuuugaagugcagguaauccucgcggggaacgcguucaccgccggaaaaauuauauuugcagcaguuccaccaaauuucccgacugaaggcuugagucccagccagguuacuauguucccccacauaauaguggauguuaggcaauuggaaccuguguugauccccuuaccugauguuaggaauaacuucuaucauuauaaucaaucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuugacuguugaggaaaugaccaauucaagauuccccauuccuuuggaaaaguuguucacgggucccagcagugccuuuguuguucaaccacaaaauggcagaugcacgacugauggcgugcucuuaggcaccacccaacugucuccugucaacaucugcaccuucagaggggacgucacccacauugcagguucucguaauuacacaaugaauuuggcuucucuaaauuggaacaauuaugauccaacagaagaaguuccagccccucuaggaacuccagauuucgugggaaagauccaaggugugcucacucaaaccacaaagggagaugguucgacccguggccauaaagcuacagucuacacugggagugcccccuuuacuccaaagcugggcaguguucaauucaguacugauacagaaaaugauuuugaaacucaccaaaacacaaaauucaccccaguuggugucauccaggaugguagcaccacccaccgaaaugaaccccaacaaugggugcucccaaguuauucagguagagaugucccuaauguacaccuagccccugcuguagcccccacuuucccgggugaacaacuucuuuucuuuaggucuacuaugcccggaugcagcggauaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcccacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5696 - RNA, 1623 nt, Artificial Sequence
  VP1__Norovirus__BAS30212
augaagauggcgucuaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcacccuuaggcccugaucugaaucccuaccuaucucauuuggccagaauguauaauggcuaugcaggugguuuugaagugcagguaauccucgcggggaacgcguucaccgccggaaaaauuauauuugcagcagucccaccaaauuucccgacugaaggcuugagucccagccaggucacuauguucccccacauaauaguggauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuugacuguugaggaaaugaccaauucaagguuccccauuccuuuggaaaaguuguucacgggucccaguagugccuuuguuguucaaccacaaaauggcagaugcacgacugauggcgugcucuuaggcaccacccaacugucuccugucaacaucugcaccuucaggggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagagaugucccuaauguacaccuagccccugcuguagcccccacuuucccgggugaacaacuucuuuucuuuaggucuaccaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuauguuacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5697 - RNA, 1623 nt, Artificial Sequence
  VP1__Norovirus__BAS30215
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccgggugaaauacuauggagcgcgcccuuaggcccugaucugaaucccuaccuaucucauuuggccagaauguauaaugguuaugcaggugguuuugaagugcaggugauucucgcggggaacgcguucaccgcgggaaaaauuauauuugcagcaguuccaccaaauuuuccaacugaaggcuugagucccagccaggucaccauguucccccauauaauaguggauguuaggcaauuggaaccuguguugauccccuuaccugauguuaggaauaacuucuaccacuauaaucagucaaaugacucuaccauuaaauugauagcaaugcuguauacaccacuuagggcuaauaaugcuggggaagauguuuuuacagucucuugucgaguucucacgaggccauccccugauuuugauuuuauauuuuugguaccaccuacaguugagucaagaacuaaaccauuuacugucccaaucuuaacuguugaagaaaugaccaauucaagauuccccauuccuuuggaaaaauuguucacgggccccagcagcgccuuuguuguucaaccacaaaauggcagaugcacgacugauggugugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccuuuaggaacuccagauuuugugggaaagauccaggguaugcucacccaaaccacaaagggagaugguucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguagcaccacccaccgaaaugaaccccaacaaugggugcucccaaguuauucagguagaaaugucccuaauguacaccuagccccugcuguagcccccacuuucccgggugaacaacuucuuuucuuuaggucuacuaugcccggaugcaguggguaucccaacauggauuuggauugccuacucccucaggagugggugcagcacuucuaccaagaggcagcuccagcacaaucugauguggcucuauugagguuugugaacccagacacggguaggguccuauuugaguguaaacuucauaaaucagguuaugucacaguggcucacaccggccagcaugauuuggucaucccccccaaugguuauuuuagguuugauuccuggguuaaucaauucuacacacuugcccccaugggaaauggaacggggcguagacgugccuuauaa

SEQ ID NO: 5698 - RNA, 1623 nt, Artificial Sequence
  VP1__Norovirus__BAS30218
augaagauggcgucuaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauucucgcggggaacgcguucaccgccggaaaaauuauauuugcagcaguuccaccaaauuuuccaacugaaggcuugagucccagccaggucacuauguucccccauauaauaguggauguuaggcaauuggaaccuguguugauccccuuaccugauguuaggaauaacuucuaccacuauaaucagucaaaugacucuaccauuaaauugauagcaaugcuguauacaccacuuagggcuaauaaugcuggggaagauguuuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggccccagcagcgccuuuguuguucaaccacaaaauggcagaugcacgacugauggugugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuuugugggaaagauccaggguaugcucacccaaaccacaaagggagaugguucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguagcaccacccaccgaaaugaaccccaacaaugggugcucccaaguuauucagguagaaaugucccuaauguacaccuagccccugcuguagcccccacuuucccgggugaacaacuucuuuucuuuaggucuacuaugcccggaugcagcggguaucccaacauggauuuggauugccuacucccucaggagugggugcagcacuucuaccaagaggcagcuccagcacaaucugauguggcucuauugagguuugugaacccagacacggguaggguccuauuugaguguaaacuucauaaaucagguuaugucacaguggcucacaccggccagcaugauuuggucaucccccccaaugguuauuuuagguuugauuccuggguuaaucaauucuacacacuugcccccaugggaaauggaacggggcguagacgugccuuauaa

SEQ ID NO: 5699 - RNA, 1623 nt, Artificial Sequence
  VP1__Norovirus__BAS30221
augaagauggcgucuagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccgggugaaauacuauggagcgcgcccuuaggcccugaucugaaucccuaccugucucauuuggccagaauguauaaugguuaugcaggugguuuugaagugcaggugauucucgcggggaacgcguucaccgccggaaaaauuauauuugcagcaguuccaccaaauuuuccaacugaaggcuugagucccagccaggucacuauguucccccauauaauaguggauguuaggcaauuggaaccuguguugauccccuuaccugauguuaggaauaacuuuuaccacuauaaucagucaaaugacucuaccauuaaauugauagcaaugcuguauacaccacuuagggcuaauaaugcuggggaagauguuuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggccccagcagcgccuuuguuguucaaccacaaaauggcagaugcacgacugauggugugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuuugugggaaagguccagggugugcucacccaaaccacaaagggagaugguucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguagcaccacccaccgaaaugaaccccaacaaugggugcucccaaguuauucagguagaaaugucccuaauguacaccuagccccugcuguagcccccacuuucccgggugaacaacuucuuuucuuuaggucuacuaugcccggaugcagcggguaucccaacauggauuuggauugccuacucccucaggagugggugcagcacuucuaccaagaggcagcuccagcacaaucugauguggcucuauugagguuugugaacccagacacggguaggguccuauuugaguguaaacuucauaaaucagguuaugucacaguggcucacaccggccagcaugauuuggucaucccccccaaugguuauuuuagguuugauuccuggguuaaucaauucuacacacuugcccccaugggaaauggaacggggcguagacgugccuuauaa

SEQ ID NO: 5700 - RNA, 1623 nt, Artificial Sequence
  VP1__Norovirus__BAS30224
augaagauggcgucuaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccgggugaaauacuauggagcgcgcccuuaggcccugaucugaaucccuaccuaucucauuuggccagaauguauaaugguuaugcaggugguuuugaagugcaggugauucucgcggggaacgcguucaccgccggaaaaauuauauuugcagcaguuccaccaaauuuuccaacugaaggcuugagucccagccaggucacuauguucccccauauaauaguggauguuaggcaauuggaaccuguguugauccccuuaccugauguuaggaauaacuucuaccacuauaaucagucaaaugacucuaccauuaaauugauagcaaugcuguauacaccacuuagggcuaauaaugcuggggaagauguuuuuacagucucuugucgaguucucacgaggccauccccugauuuugauuuuauauuuuuggugccaccuacaguugagucaagaacuaaaccauuuacugucccagucuuaacuguugaagaaaugaccaauucaagauuccccauuccuuuggaaaaguuguucacgggccccagcagcgccuuuguuguucaaccacaaaauggcagaugcacgacugauggugugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuuugugggaaagauccaggguaugcucacccaaaccacaaagggagaugguucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguagcaccacccaccgaaaugaaccccaacaaugggugcucccaaguuauucagguagaaaugucccuaauguacaccuagccccugcuguagcccccacuuucccgggugaacaacuucuuuucuuuaggucuacuaugcccggaugcagcggguaucccaacauggauuuggauugccuacucccucaggagugggugcagcacuucuaccaagaggcagcuccagcacaaucugauguggcucuauugagguuugugaacccagacacggguaggguccuauuugaguguaaacuucauaaaucagguuaugucacaguggcucacaccggccagcaugauuuggucaucccccccaaugguuauuuuagguuugauuccuggguuaaucaauucuacacacuugcccccaugggaaauggaacggggcguagacgugccuuauaa

SEQ ID NO: 5701 - RNA, 1623 nt, Artificial Sequence
  VP1__Norovirus__BAS30227
augaagauggcgucuagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccgggugaaauacuauggagcgcgcccuuaggcccugaucugaaucccuaccugucucauuuggccagaauguauaaugguuaugcaggugguuuugaagugcaggugauucucgcggggaacgcguucaccgccggaaaaauuauauuugcagcaguuccaccaaauuuuccaacugaaggcuugagucccagccaggucacuauguucccccauauaauaguggauguuaggcaauuggaaccuguguugauccccuuaccugauguuaggaauaacuucuaccacuauaaucagucaaaugacucuaccauuaaauugauagcaaugcuguauacaccacuuagggcuaauaaugcuggggaagauguuuuuacagucucuugucgaguucucacgaggccauccccugauuuugauuuuauauuuuuggugccaccuacaguugagucaagagcuaaaccauuuacugucccaaucuuaacuguugaagaaaugaccaauucaagauuccccauuccuuuggaaaaauuguucacgggccccagcagcgccuuuguuguucaaccacaaaauggcagaugcacgacugauggugugcucuuaggcaccacccaacugucuccugucaacaucugcaccuucagaggggaugucacccacauugcagguucucguaauuacacaaugaauuuggcuucuccaaauuggaacaauuaugacccaacagaagaaauuccagccccucuaggaacuccagauuuugugggaaagauccaggguaugcucacccaaaccacaaagggagaugguucgacccguggccauaaagccacaguuuacacugggagugcccccuuuacuccaaagcugggcaguguucaauucaguacugacacagaaaaugauuuugaaacucaccaaaacacaaaauucaccccagucggugucauccaggaugguagcaccacccaccgaaaugaaccccaacaaugggugcucccaaguuauucagguagaaaugucccuaauguacaccuagccccugcuguagcccccacuuucccgggugaacaacuucuuuucuuuaggucuacuaugcccggaugcagcggguaucccaacauggauuuggauugccuacucccucaggagugggugcagcacuucuaccaagaggcagcuccagcacaaucugauguggcucuauugagguuugugaacccagacacggguaggguccuauuugaguguaaacuucauaaaucagguuaugucacaguggcucacaccggccagcaugauuuggucaucccccccaaugguuauuuuagguuugauuccuggguuaaucaauucuacacacuugcccccaugggaaauggaacggggcguagacgugccuuauaa

SEQ ID NO: 5702 - RNA, 1623 nt, Artificial Sequence
  VP1__Norovirus__BAS30230
augaagauggcgucuaacgacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccgggugaaauacuauggagcgcgcccuuaggcccugaucugaaucccuaccuaucucauuuggccagaauguauaauaguuaugcaggugguuuugaagugcaggugauucucgcggggaacgcguucaccgccggaaaaauuauauuugcagcaguuccaccaaauuuuccaacugaaggcuugagucccagccaggucacuauguucccccauauaauaguggauguuaggcaauuggaaccuguguugauccccuuaccugauguuaggaauaacuucuaccacuauaaucagucaaaugacucuaccauuaaauugauagcaaugcuguauacaccacuuagggcuaauaaugcuggggaagauguuuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggccccagcagugccuuuguuguucaaccacaaaauggcagaugcacgacugauggugugcucuuaggcaccacccaacugucuccugucaacaucugcaccuucagaggggaugucacccacauugcaaguucucguaauuacacaaugaauuuggcuucucuaaauuggaacaauuaugacccaacagaagaaauuccagccccucuaggaacuccagauuuugugggaaagauccaggguaugcucacccaaaccacaaagggagaugguucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguagcaccacccaccgaaaugaaccccaacaaugggugcucccaaguuauucagguagaaaugucccuaauguacaccuagccccugcuguagcccccgcuuucccgggugaacaacuucuuuucuuuaggucuacuaugcccggaugcagcggguaucccaacauggauuuggauugccuacucccucaggagugggugcagcacuucuaccaagaggcagcuccagcacaaucugauguggcucuauugagguuugugaacccagacacggguaggguccuauuugaguguaaacuucauaaaucagguuaugucacaguggcucacaccggccagcaugauuuggucaucccccccaaugguuauuuuagguuugauuccuggguuaaucaauucuacacacuugcccccaugggaaauggaacggggcguagacgugccuuauaa

SEQ ID NO: 5703 - RNA, 1623 nt, Artificial Sequence
  VP1__Norovirus__BAS30233
augaagauggcgucgaaugacgccaacccaucugauggguccgcagccaaccucgucccagaggucaacaaugagguuauggcuuuggagcccguugucggugccgcuauugcggcgcccguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucacuuggccagaauguauaaugguuaugcaggugguuuugaagugcaggugauccucgcggggaacgcguucaccgccggaaaaauuauauuugcagcagucccaccaaacuuuccaacugaaggcuugagucccagccaggucacuauguucccccauauaauaguggauguuaggcaauuggaaccuguguugaucccccuaccugauguuaggaauaacuucuaucacuauaaccagucaaaugauucuaccauuaaauugauagcaaugcuguauacaccacuuagggcuaauaaugcuggggaagaugucuucacagucucuugucgaguucucacgaggccauccccugauuuugauuuuauauucuuagugccacccacaguugagucaaggacuaaaccauuuacugucccaaucuuaacuguugaagaaaugaccaauucaagauuccccauuccuuuggaaaaauuguucacgggucccagcagugccuuuguuguccaaccacaaaauggcagaugcacgacugauggcgugcucuuaggcaccacccaacugucgccugucaauauuugcaccuucagaggggaugucacccacauugcagguucucguaauuacacaaugaauuuggccucucuaaauuggaacaauuaugacccaacagaagaaaucccagccccucuagggacuccagacuucgugggaaagauucaaggugugcucacucaaaccacaaagggagauggcucgacccguggccauaaagcuacaguuuacacugggagugcccccuuuacuccaaagcuggguaguguucaauucaguacugauacagagaaugauuuugaaacucaccaaaauacaaaauucaccccagucggugucauccaggaugguggcaccacccaccgaaaugaaccccaacaaugggugcucccaaguuauucagguaggaauguccccaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugacuccuggguuaaucaauucuacacgcuugcccccaugggaaauggaacggggcguagacgugcuuuauaa

SEQ ID NO: 5704 - RNA, 1623 nt, Artificial Sequence
  VP1__Norovirus__BAS30236
augaagauggcgucuaacgacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaacuuuguacaagccccugguggagaguucacaguguccccuagaaacgcuccgggugaaauacuauggagcgcgcccuuaggcccugaucugaaucccuaccuaucucauuuggccagaauguauaaugguuaugcaggugguuuugaagugcaggugauucucgcggggaacgcguucaccgccggaaaaauuauauuugcagcaguuccaccaaauuuuccaacugaaggcuugagucccagccaggucacuauguucccccauauaauaguggauguuaggcaauuggaaccuguguugauccccuuaccugauguuaggaauaacuucuaccacuauaaucagucaaaugacucuaccauuaaauugauagcaaugcuguauacaccacuuagggcuaauaaugcuggggaagauguuuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggccccagcagcgccuuuguuguucaaccacaaaauggcagaugcacgacugauggugugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuuugugggaaagauccaggguaugcucacccaaaccacaaagggagaugguucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguagcaccacccaccgaaaugaaccccaacaaugggugcucccaaguuauucagguagaaaugucccuaauguacaccuagccccugcuguagcccccacuuucccgggugaacaacuucuuuucuuuaggucuacuaugcccggaugcagcggguaucccaacauggauuuggauugccuacucccucaggagugggugcagcacuucuaccaagaggcagcuccagcacaaucugauguggcucuauugagguuugugaacccagacacggguaggguccuauuugaguguaaacuucauaaaucagguuaugucacaguggcucacaccggccagcaugauuuggucaucccccccaaugguuauuuuagguuugauuccuggguuaaucaauucuacacacuugcccccaugggaaauggaacggggcguagacgugccuuauaa

SEQ ID NO: 5705 - RNA, 1623 nt, Artificial Sequence
  VP1__Norovirus__BAS30239
augaagauggcgucuaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccgggugaaauacuauggagcgcgcccuuaggcccugaucugaaucccuaccuaucucauuuggccagaauguauaaugguuaugcaggugguuuugaagugcaggugauucucgcggggaacgcguucaccgccggaaaaauuauauuugcagcaguuccaccaaauuuuccaacugaaggcuugagucccagccaggucacuauguucccccauauaauaguggauguuaggcaauuggaaccuguguugauccccuuaccugauguuaggaauaacuucuaccacuauaaucagucaaaugacucuaccauuaaauugauagcaaugcuguauacaccacuuagggcuaauaaugcuggggaagauguuuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggccccagcagcgccuuuguuguucaaccacaaaauggcagaugcacgacugauggugugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuuugugggaaagauccaggguaugcucacccaaaccacaaagggagaugguucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguagcaccacccaccgaaaugaaccccaacaaugggugcucccaaguuauucagguagaaaugucccuaauguacaccuagccccugcuguagcccccacuuucccgggugaacaacuucuuuucuuuaggucuacuaugcccggaugcagcggguaucccaacauggauuuggauugccuacucccucaggagugggugcagcacuucuaccaagaggcagcuccagcacaaucugauguggcucuauugagguuugugaacccagacacggguaggguccuauuugaguguaaacuucauaaaucagguuaugucacaguggcucacaccggccagcaugauuuggucaucccccccaaugguuauuuuagguuugauuccuggguuaaucaauucuacacacuugcccccaugggaaauggaacggggcguagacgugccuuguaa

SEQ ID NO: 5706 - RNA, 1623 nt, Artificial Sequence
  VP1__Norovirus__BAS30242
augaagauggcgucuaacgacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacgguauccccuagaaacgcuccaggugaaauacuauggagcgcacccuuaggcccugaucugaaucccuaccuaucucauuuggccagaauguauaaugguuaugcaggugguuuugaagugcagguaauccucgcggggaacgcguucaccgccggaaaaauuauauuugcagcagucccaccaaauuucccgacugaaggcuugagucccagccaggucacuauguucccccacauaauaguggauguuaggcaauuggaaccuguguugauccccuuaccugauguuaggaauaacuucuaucauuauaaucaaucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccacccacaguugagucaagaacuaaaccauuuacugucccaaucuugacuguugaggaaaugaccaauucaagauuccccauuccuuuggaaaaguuguucacgggucccagcagugccuuuguuguucaaccacaaaauggcagaugcacgacugauggcgugcucuuaggcaccacccaacugucuccugucaacaucugcaccuucagaggggacgucacccacauugcagguucucguaauuacacaaugaauuuggcuucucuaaauuggaacaauuaugauccaacagaagaaguuccagccccucuaggaacuccagauuucgugggaaagauccaaggugugcucacucaaaccacaaagggagaugguucgacccguggccauaaagcuacagucuacacugggagugcccccuuuacuccaaagcugggcaguguucaauucaguacugauacagaaaaugauuuugaaacucaccaaaacacaaaauucaccccaguuggugucauccaggaugguggcaccacccaccgaaaugaaccccaacaaugggugcucccaaguuauucagguagagaugucccuaauguacaccuagccccugcuguagcccccacuuucccgggugaacaacuucuuuucuuuaggucuacuaugcccggaugcagcggauaucccaacauggauuuggauugccuacucccccaggagugggugcagcacuucuaccaagaggcagcuccagcacaaucugauguggcucuauugagauuugugaauccagacacggguaggguccuguuugagugcaagcuucauaaaucaggcuaugucacaguggcccacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5707 - RNA, 1620 nt, Artificial Sequence
  VP1__Norovirus__BAS30245
augaagauggcgucuaacgacgccaacccaucugauggguccgcagccaaccucgucccagaggucaacaaugagguuauggcuuuggagcccguuguuggugccgcuaucgcggcacccguagcgggccaacaaaauguaauugaccccuggauuaggaacaauuuuguacaagccccugguggagaguucacaguguccccuagaaacgcuccaggugaaauacuauggagcgcgcccuuaggcccugaucugaacccauaccuuucccaccuggccagaauguacaaugguuaugcagguggcuuugaagugcagguaauccuugcggggaacgcguucaccgcagguaaaaucauauuugcagcaaucccaccaaauuuuccaacugaaggcuugagccccagucaggucacuauguucccccauauaguaguagauguuaggcaauuggaaccuguauugauccccuuaccugauguuaggaacaauuucuaccacuacaaucaaacaaaagaguccaccaucaaauugguagcaaugcuguacacaccacuuagggcuaauaaugcuggggaugaugucuucacagucucuugucgaguccucacgagaccaucccccgauuuugauuucauauuucuggugccacccucaguugaaucaagaaccaaaccauucaccgucccaauuuuaacuguugaggaaaugaccaauucaagauuccccauaccuuuggaaagauuguucacggguccuagcagugccuuugucguccagccacaaaauggcaggugcacgacugauggcgugcucuuaggcaccacccaacugucccccgucaacaucugcaccuucagaggggacgucacccgaguuucaaccacucauguuuaugaaaugaauuuggcuucucaaaauuggaauaauuaugacccaacagaagaagucccagccccucugggaacuccagauuuugugggaaagauccaaggcgugcucacccaaaccacaaggacagacgguucgacccgcgcccacaaagcaacggugagcacuggggcugccgacuucacuccaaaacugggcagcauccgguucgaaaccaccacgaaccgugaucuugaaacucaccaaaacacaaaguucaccccagucggugucauccaggauggugacaaccaccaaaaugaaccccaacaauggagacucccagguuacgcagguagggaugcucacaacgugcaccuagccccugccguagcccccacuuucccgggugagcaacuccuuuucuucagauccaccaugcccggaugcaguggguaucccaacaugaauuuggauugucuacucccccaagaaugggugcagcacuucuaccaagaggcagccccagcacaaucugauguggcucuguugagauucgugaauccagacacggguagaguucuguuugagugcaagcuucacaaaucaggcuaucucacaguggcccacaccggcccguaugauuuggucaucccccccaauggcuacuucagauuugauucgugggucaaccaguucuacacucuugcccccaugggaaauggaacggggcguagacgugcauuauaa

SEQ ID NO: 5708 - RNA, 1623 nt, Artificial Sequence
  VP1__Norovirus__BAS30248
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccacauaauaguagauguuaggcaauuggaaccuguguugauccccuuacccgauguuaggaauaauuucuaucacuacaaucaaucaaaugaccccaccaucaaauugauagcaauguuguauacaccacuuagggcuaauaaugcuggggacgaugucuucacaguuucuugucggguucucacgagaccaucccccgauuuugacuucauauuuuuaguaccacccacaguugagucaagaacuaaaccauucucuguuccaauuuuaacuguugaggagaugaccaauucaagauuccccauuccuuuggaaaagcuguucacgggucccagcagugccuuuguuguucaaccacaaaacggcagaugcacgacugauggcgugcuccuagguaccacucaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucguggggaagauucaaggugugcucacccaaaccacaagggcagauggcucgacccgcggccacaaagcuauaguguacacugggagcgccgauuucgcuccaaaacuggguagaguucaauuugccacugacacagacaaugauuuuggugcuaaccaaaauacaaaguucaccccagucggugucauccaggauggugacacugcccaccgaaaugaaccccaacaaugggugcucccaaguuacucaggcagaaauagucacaaugugcaccuggcucccgcuguagcccccacuuuuccgggugagcaacuucucuucuucagauccacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggucaacaugauuugguuaucccccccaaugguuauuuuagauuugauuccugggucaaccaguucuacacacuugcccccaugggaaaugggacggggcguagacgugcauuauaa

SEQ ID NO: 5709 - RNA, 1623 nt, Artificial Sequence
  VP1__Norovirus__BAS30251
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccacauaauaguagauguuaggcaauuggaaccuguguugauccccuuacccgauguuaggaauaauuucuaucacuacaaucaaucaaaugaccccaccaucaaauugauagcaauguuguauacaccacuuagggcuaauaaugcuggggacgaugucuucacaguuucuugucggguucucacgagaccaucccccgauuuugacuucauauuuuuaguaccacccacaguugagucaagaacuaaaccauucucugucccaauucuaacuguugaggagaugaccaauucaagauuccccauuccuuuggaaaagcuguucacaggucccagcagugccuuuguuguucaaccacaaaacggcagaugcacgacugauggcgugcuccuaggcaccacucaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucguggggaagauucaaggugugcucacccaaaccacaagggcagauggcucgacccgcggccacaaagcuacaguguacacugggagcgccgauuuugcuccaaaacuggguagaguccaauuugccacugacacagacaaugauuuugaugcuaaccaaaacacaaaguucaccccagucggugucauccaggauggugacacugcccaccgaaaugaaccccaacaaugggugcucccaaguuacucaggcagaaauagucacaaugugcaccuggcccccgcuguagcccccacuuuuccgggugagcaacuucucuucuucagauccacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuaugucacaguggcucacaccggucaacaugauuugguuaucccccccaaugguuauuuuagauuugauuccugggucaaccaguucuacacacuugcccccaugggaaauggaacagggcguagacgugcauuauaa

SEQ ID NO: 5710 - RNA, 1626 nt, Artificial Sequence
  VP1__Norovirus__BAS30254
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaauuauauuugcagcagucccaccaaacuucccaacugaagguuugagccccagccaggucacuauguucccccacauaauaguagauguuaggcaauuggaaccuguguugauccccuuacccgauguuaggaauaacuucuaccauuauaaucaaucaaaugaccccaccaucaaauugauagcaauguuguacacaccacuuagggcuaauaacgccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaaagguuucccccauucccuugaaaaaguuguucacgggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccaccgacacagacaaugauuuugaaacuaaccaaaacacaaaguucaccccagucgguguuauucaggaugguaguacuaccccccgaaaugaaccccaacaaugggugcucccaaguuauucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguauuucuaccaggaggcagccccagcacaaucugauguggcucuguugagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 5711 - RNA, 1623 nt, Artificial Sequence
  VP1__Norovirus__BAS30257
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauauuauggagcgcgcccuuaggcccugauuugaaucccuaccuuucccauuuggccagaauguauaaugguuaugcaggugguuuugaagugcagguaauccucgcggggaacgcguucaccgccgggaaaaucauauuugcagcagucccaccaaauuucccaacugaaggucugagccccagccaggucacuauguucccccacauaauaguagauguuaggcaauuggaaccuguguugauccccuuacccgauguuaggaauaauuucuaccauuauaaucaaucaaaugauuccaccaucaaauugauagcaauguuguacacaccacuuagggcuaauaaugccggggacgaugucuucacaguuucuugccgaguucucacgagaccaucccccgauuuugauuucauauuuuuggugccacccacaguugagucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggagaugucacccauauuucaggcagucguaacuacacaaugaauuuggccucccaaaauuggaacaguuacgauccaacagaagaaaucccagccccucuaggaacuccagauuucguggggaagauucaaggugugcucacccaaaccacaaggacaaaugguucgacccgcggccacaaagcuacaguguacacugggagcgccgacuuuucuccaaaacuggguagaguccaauuugccacugacacagacaaugauuuugaaacuaaccaaaacacaaaguucaccccagucgguguuauccaggaugguaguacuaccccccgaaaugaaccccaacaaugggugcuuccaaguuacucaggcagaaacauucauaaugugcaccuggcccccgcuguagcccccacuuucccgggcgagcagcuccucuucuucagaucuacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugagugcaagcuucauaaaucaggcuauguuacaguggcucacacuggccaacaugauuugguuaucccccccaaugguuauuuuagauuugauuccuggguuaaccaguucuacacacuugcccccaugggaaaugggacggggcguagacgugcauuauaa

SEQ ID NO: 5712 - RNA, 1623 nt, Artificial Sequence
  VP1__Norovirus__BAS30260
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauauuauggagcgcgcccuuaggcccugauuugaaucccuaccuuucccauuuggcuagaauguacaaugguuaugcaggugguuuugaagugcagguaauccucgcggggaacgcguucaccgccgggaaaauuauauuugcagcagucccaccaaacuucccaacugaagguuugagccccagccaggucacuauguucccccacauaauaguagauguuaggcaauuggaaccuguguugauccccuuacccgauguuaggaauaacuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccgacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccaccgacacagacaaugauuuugaaacuaaccaaaacacaaaguucaccccagucgguguuauucaggaugguaguacuaccccccgaaaugaaccccaacaaugggugcucccaaguuauucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguauuucuaccaggaggcagccccagcacaaucugauguggcucuguugagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 5713 - RNA, 1623 nt, Artificial Sequence
  VP1__Norovirus__BAS30263
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguauaaugguuaugcaggugguuuugaagugcagguaauccucgcggggaacgcguucaccgccgggaaaaucauauuugcagcagucccaccaaauuucccaacugaaggucugagccccagccaggucacuauguucccccacauaauaguagauguuaggcaauuggaaccuguguugauccccuuacccgauguuaggaauaauuucuaccauuauaaucaaucaaaugauuccaccaucaaauugauagcaauguuguacacaccacuuagggcuaauaaugccggggacgaugucuucacaguuucuugucgaguucucacgagaccaucccccgauuuugauuucauauuuuuggugccacccacaguugagucagagacuaaaccauucuuuuucccagucuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaaugguucgacccgcggccacaaagcuacaguguacacugggagcgccgacuuuucuccaaaacuggguagaguccaauuugccacugacacagacaaugauuuugaaacuaaccaaaacacaaaguucaccccagucgguguuauccaggaugguaguacuaccccccgaaaugaaccccaacaaugggugcuuccaaguuacucaggcagaaacauucauaaugugcaccuggcccccgcuguagcccccacuuucccgggcgagcagcuccucuucuucagaucuacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugagugcaagcuucauaaaucaggcuauguuacaguggcucacacuggccaacaugauuugguuaucccccccaaugguuauuuuagauuugauuccuggguuaaccaguucuacacacuugcccccaugggaaaugggacggggcguagacgugcauuauaa

SEQ ID NO: 5714 - RNA, 1623 nt, Artificial Sequence; identical to SEQ ID NO: 5711
  VP1__Norovirus__BAS30266

SEQ ID NO: 5715 - RNA, 1623 nt, Artificial Sequence; identical to SEQ ID NO: 5711
  VP1__Norovirus__BAS30269

SEQ ID NO: 5716 - RNA, 1623 nt, Artificial Sequence; identical to SEQ ID NO: 5711
  VP1__Norovirus__BAS30272

SEQ ID NO: 5717 - RNA, 1623 nt, Artificial Sequence
  VP1__Norovirus__BAS30275
augaagauggcgucuaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuuucccauuggccagaaaggucaaagguuaugcaggggguuuugaagugcagguaauucuugcggggaaagcguuccccgccgggaaaaucauauuugcagcauccccacccaauuuuccaacugaaggcuugagucccagccaggucacuauguucccccauauaauaguggauguuaggcaauuggaaccuguguugauccccuuaccugauguuaggaauaacuucuaucauuauaaucaaucaaaugacuccaccaucaaauugauagcaauguuguauacaccacuuagggcuaauaaugcuggggaagaugucuucacagucucuugucgaguucuuacgagaccaucccccgauuuugauuucauauuuuuggugccacccacaguugagucaagaacuaaaccauucucugucccaauuuuaacuguugaagaaaugaccaauucaagguuccccauuccuuuggaaaaguuguucacgggucccaguaguaccuuuguuguucaaccacaaaacggcaggugcacgacugauggcgugcucuuaggcacuacccaacugucuccugucaacaucugcaccuuuagaggggaugucacccacauugcaggcucucguaauuacacaaugaauuuggcuucucaaaauuggaacaguuaugacccaacagaagaaaucccagccccucuaggaacuccagauuucguggggaagauucaaggugugcucacccaaaccacaaggagagaugguucgacccgcggccacaaagcuacaguguacacugggagugccgacuuuucuccaaaacuggguagaguucaauuugccacugacacagacaaugauuuugauacucaccaaaacacaaaguucaccccagucgguguuauccaggauggugguacugcccaccgaaaugaaccccaacaaugggugcucccaaguuacucaggcagaaauacucauaaugugcaccuggccccugcuguagcccccacuuucccgggugagcaacuccucuucuucagaucuacuaugcccggaugcagcggguaccccaacauggauuuggauugucugcuuccccaggagugggugcaguauuucuaccaagaagcagccccagcacaaucugauguggcucugcuaagauuugugaauccagacacagguaggguuuuguuugaguguaagcuucauaaaucaggcuauguuacaguggcccacaccggccaacaugauuugguuaucccccccaaugguuauuuuagauuugauuccugggucaaccaguucuacacacuugcccccaugggaaauggaacggggcguagacgugcauuguaa

SEQ ID NO: 5718 - RNA, 1623 nt, Artificial Sequence; identical to SEQ ID NO: 5711
  VP1__Norovirus__BAS30278

SEQ ID NO: 5719 - RNA, 1623 nt, Artificial Sequence
  VP1__Norovirus__BAS30284
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccacuuggccagaauguacaaugguuaugcaggugguuuugaagugcagguaauccucgcggggaacgcguucaccgccgggaaaauuauauuugcagcagucccaccaaacuucccaacugaagguuugagccccagccaggucaccauguucccccacauaauaguagauguuaggcaauuggaaccuguguugauccccuuacccgauguuaggaauaacuucuaccauuauaaucaaucaaaugaccccaccaucaaauugauagcaauguuguacacaccacuuagggcuaauaaugccggggacgauguuuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuucaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagccacaguguacacugggagcgccgacuuuucuccaaaacuggguagaguucaauuugccaccgacacagacaaugauuuugaaacuaaccaaaacacaaaguucaccccagucgguguuauucaggauggcaguacuaccccccgaaaugaaccccaacaaugggugcucccaaguuauucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguauuucuaccaggaggcagccccagcacaaucugauguggcucuguugagauuugugaauccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcgcagacgugcauuauaa

SEQ ID NO: 5720 - RNA, 1623 nt, Artificial Sequence
  VP1__Norovirus__BAS30287
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccgacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuggguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccagcaugauuugguuaucccccccaaugguuauuuuagauuugauuccuggaucaaccaguucuacacacuugcccccaugggaaaugggacggggcguagacgugcauuauaa

SEQ ID NO: 5721 - RNA, 1623 nt, Artificial Sequence
  VP1__Norovirus__BAS30290
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauauuauggagcgcgcccuuaggcccugauuugaaucccuaccuuucccauuuggccagaauguauaaugguuaugcaggugguuuugaagugcagguaauccucgcggggaacgcguucaccgccgggaaaaucauauuugcagcagucccaccaaauuucccaacugaaggucugagccccagccaggucacuauguucccccacauaauaguagauguuaggcaauuggaaccuguguugauccccuuacccgauguuaggaauaauuucuaccauuauaaucaaucaaaugauuccaccaucaaauugauagcaauguuguacacaccacuuagggcuaauaaugccggggacgaugucuucacaguuucuugccgaguucucacgagaccaucccccgauuuugauuucauauuuuuggugccacccacaguugagucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggagaugucacccauauuucaggcagucguaacuacacaaugaauuuggccucccaaaauuggaacaguuacgauccaacagaagaaaucccagccccucuaggaacuccagauuucguggggaagauucaaggugugcucacccaaaccacaaggacaaaugguucgacccgcggccacaaagcuacaguguacacugggagcgccgacuuuucuccaaaacuggguagaguccaauuugccacugacacagacaaugauuuugaaacuaaccaaaacacaaaguucaccccagucgguguuauccaggaugguaguacuaccccccgaaaugaaccccaacaaugggugcuuccaaguuacucaggcagaagcauucauaaugugcaccuggcccccgcuguagcccccacuuucccgggcgagcagcuccucuucuucagaucuacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugagugcaagcuucauaaaucaggcuauguuacaguggcucacacuggccaacaugauuugguuaucccccccaaugguuauuuuagauuugauuccuggguuaaccaguucuacacacuugcccccaugggaaaugggacggggcguagacgugcauuauaa

SEQ ID NO: 5722 - RNA, 1623 nt, Artificial Sequence
  VP1__Norovirus__BAS30293
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuagaaccuguguugauccccuuacccgauguuaggaauaauuucuaccauuauaaucaaucaaaugaccccaccaucaaauugauagcaauguuguauacaccacuuagggcuaauaaugcuggggacgaugucuucacaguuucuugucgaguucuuacgagaccaucccccgauuuugauuucauauuuuuagugccacccacaguugaaucaagaacuaaaccauucucugucccaauuuuaacuguugaggagaugaccaauucaagguuccccauuccuuuggaaaaguuguucacgggccccaguaguaccuuuguuguucaaccacaaaacggcaggugcacgacugauggcgugcuccuagguacuacccaacugucuccugucaacaucugcaccuuuagaggggaugucacccacauugcaggcagucguaacuacacaaugaaucuggcuucccaaaauuggaacaguuaugacccaacagaagaaaucccagccccucuaggaacuccagauuucguggggaagauucaaggugugcucacccaaaccacaaggacagauggcucgacccgcggccacaaagcuacaguguacacugggagcgccgacuuuucuccaaaacuggguaggguucaauuugccacugacacagacaaugauuucgaugcuaaccaaaacacaaaguucaccccagucgguguuauccaggauggugguacugcccaccgaaaugaaccccaacaaugggugcucccaaguuacucaggcagaaauacucauaaugugcaccuggcccccgcuguagcccccacuuuuccgggugagcaacuccucuucuucagaucuaccaugcccggaugcagcggguaccccaacauggauuuggacugucugcuuccccaggaaugggugcaguauuucuaucaggaagcagccccagcacaaucugauguggcucugcuaagauuugugaauccagacacagguaggguuuuguuugaguguaagcuucauaaaucaggcuaugcuacaguggcccacacuggccaacaugauuugguuaucccccccaaugguuauuuuagauuugauuccugggucaaccaguucuacacacuugcccccaugggaaaugggacggggcguagacgugcauuguaa

SEQ ID NO: 5723 - RNA, 1623 nt, Artificial Sequence
  VP1__Norovirus__BAS30296
augaagauggcgucuaaccacgucaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucucacuuggccagaauguacaaugguuaugcaggugguuuugaagugcagguaauccucgcggggaacgcguucaccgccgggaaaaucauauuugcagcagucccaccaaauuucccgacugaagguuugagccccagccaggucacuauguucccccacauaauaguagaugucaggcaauuggaaccuguguugauccccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccaucccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauucauaaugugcaccuggcccccgcuguagccccuacuuucccaggcgagcagcuccucuucuucagauccauuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccagcaugauuugguuaucccccccaaugguuauuuuagauuugauuccugggucaaccaguucuacacacuugcccccaugggaaaugggacggggcguagacgugcauuauaa

SEQ ID NO: 5724 - RNA, 1623 nt, Artificial Sequence
  VP1__Norovirus__BAS30299
augaagauggcgucgagugacgccaacccaucugauggguccacagccaaccucgucccagaggucaauaaugagguuauggcuuuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucguauuugcagcagucccaccaaauuucccaacugaagguuugagccccagccaggucacuauguucccccacauaauaguagauguuaggcaauuggaaccuguguugauccccuuacccgauguuaggaauaauuucuaucauuauaaccaaucaaaugaccccaccaucaaauugauagcaauguuguauacaccacuuagggcuaauaaugcuggggacgaugucuucacaguuucuugucgaguucucacgagaccaucccccgauuuugauuucauauuucuagugccacccacaguugaaucaagaacuaaaccauucucugucccaauucuaacuguugaggagaugaccaauucaagguuccccauuccuuuggaaaaguuguucacgggccccaguagugcuuuuguuguucaaccacaaaacggcaggugcacgacugauggcgugcuccuagguacuacccaacugucuccugucaacaucugcaccuucagaggggaugucacccauauugcaggcagucauaacuacacaaugaaucuggcuucccaaaauuggaacaguuaugacccaacagaggaaaucccagccccucuaggaaccccagauuucguggggaagauucaaggugugcucacccaaaccacaaggacggauggcucgacccgcggccacaaagcuacaguguacacugggagcgccgaauuuuccccaaaacuggguagaguucaauuugccacugacacaaacaaugauuuugaugcuaaccaaaacacaaaguucaccccagucggugucauccaggauggugguacuacccaccgaaaugaaccccaacaaugggugcuuccaaguuacucaggcagaaauacucauaaugugcaccuggcccccgcuguagcccccacuuuuccgggugagcagcuccucuucuucagaucuaccaugcccggaugcagcggguaccccaacauggauuuggacugucugcucccccaggaaugggugcaguauuucuaccaggaggcagccccagcacaaucugauguggcucugcuaagauuugugaacccagacacagguaggguguuguuugaguguaagcuucauaaaucaggcuauguuacaguggcccacacuggccaacaugauuugguuaucccccccaaugguuauuuuagauuugauuccugggucaaccaguucuacacacuugcccccaugggaaaugggacggggcguagacgugcauuguaa

SEQ ID NO: 5725 - RNA, 1623 nt, Artificial Sequence
  VP1__Norovirus__BAS30302
augaagauggcgucgagugacgccaacccauuugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuguccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagaugucaggcaauuggaaccuguguugauucccuuacccgauguuagaaauaauuucuaccauuauaaucaaucaaaugaccccaccaucaaauugauagcaauguuguauacaccacuuagggcuaauaaugccggggaugaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggucccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccguggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuauucaggcagaaacauucauaaugugcaccuggcccccgcuguagcccccacuuucccgggcgagcagcuccucuucuucagaucuacuaugcccggaugcagcggguaccccaacauggacuuggacugucugcucccccaggaaugggugcaguauuucuaccaggaggcagccccagcacaaucugauguggcucuuuuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 5726 - RNA, 1623 nt, Artificial Sequence
  VP1__Norovirus__BAS30305
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcggaacauuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuacaaucaaucaaaugaccccaccaucaaauugauagcaauguuguacacaccacuuagggcuaauaaugccggggacgaugucuucacaguuucuugucgaguucucacgagaccaucccccgauuuugauuucauauuucugguaccacccacaguugaaucaagaacuaaaccauucucugucccaguuuuaacuguugaggagaugaccaauucaagguuccccauuccuuuggaaaaguuguucacgggucccaguagugccuuuguuguucaaccacaaaauggcaggugcacgacugauggugugcuccuaggcacuacccaacugucucccgucaacaucugcaccuucagaggggaugucacccauauuccaggcagucguaacuacacaaugaauuuggccucccaaaauuggaacaguuacgauccaacagaagaaaucccagccccccuaggaacuccagauuucguggggaagauucaaggugugcucacccaaaccacaaggacaaauggcucgacccgcggccacaaagcuacaguguacacugggagcgccgacuuuucuccaaaacuggguagaguccaauuugccacugacacagacaaugauuuugaaaccaaccaaaacacaaaguucaccccagucgguguuauccaggaugguaguaccaccccccgaaaugaaccccaacaaugggugcucccaaguuacucaggcagaaacauucacaaugugcaccuggcccccgcuguagcccccacuuucccgggcgagcagcuccucuucuucagaucuacuaugcccggaugcagcggguaccccaacauggacuuggacugucugcucccccaggaaugggugcaguauuucuaccaggaggcagccccagcacaaucugauguggcgcugcuaagauuugugaacccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 5727 - RNA, 1626 nt, Artificial Sequence
  VP1__Norovirus__BAS30308
augaagauggcgucuaacgacgucaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguauaaugguuaugcaggugguuuugaagugcagguaauccucgcggggaacgcguucaccgccgucgugagaaucauauuuucagcagucccaccaaauuucccaacugaaggucugagccccagccaggucacuauguucccccacauaauaguagauguuaggcaauuggaaccuguguugauccccuuacccgauguuaggaauaauuucuaccauuauaaucaaucaaaugauuccaccaucaaauugauagcaauguuguacacaccacuuagggcuaauaaugccggggacgaugucuucacaguuucuugccgaguucucacgagaccaucccccgauuuugauuucauauuuuuggugccacccacaguugagucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggagaugucacccauauuucaggcagucguaacuacacaaugaauuuggccucccaaaauuggaacaguuacgauccaacagaagaaaucccagccccucuaggaacuccagauuucguggggaagauucaaggugugcucacccaaaccacaaggacaaaugguucgacccgcggccacaaagcuacaguguacacugggagcgccgacuuuucuccaaaacuggguagaguccaauuugccacugacacagacaaugauuuugaaacuaaccaaaacacaaaguucaccccagucgguguuauccaggaugguaguacuaccccccgaaaugaaccccaacaaugggugcuuccaaguuacucaggcagaaacauucauaaugugcaccuggcccccgcuguagcccccacuuucccgggcgagcagcuccucuucuucagaucuacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugagugcaagcuucauaaaucaggcuauguuacaguggcucacacuggucaacaugauuugguuaucccccccaaugguuauuuuagauuugauuccuggguuaaccaguucuacacacuugcccccaugggaaaugggacggggcguagacgugcauuauaa

SEQ ID NO: 5728 - RNA, 1623 nt, Artificial Sequence
  VP1__Norovirus__BAS30311
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucaaucaaaugacuccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaagagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccaacaugacuugguuaucccccccaaugguuauuuuagauuugauuccugggucaaccaguucuacacacuugcccccaugggaaaugggacggggcguagacgugcauuauaa

SEQ ID NO: 5729 - RNA, 1623 nt, Artificial Sequence
  VP1__Norovirus__BAS30314
augaagauggcgucuagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccgacugaagguuugagucccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuucuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaagguguacucacccaaaccacaaggacaaauggcucgacccgcggccacaaagcuacaguguacacugggagcgccgacuuuucuccaaaacuggguagaguucaauuugccacugacacagacaaugauuuugaaaauaaccaaaacacaaaguucaccccagucgguguuauccaggaugguaguacuaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugacguggcucuguuaagauuugugaauccagacacagguaggguuuuguuugaguguaagcuucauaaaucaggcuauguuacaguggcucacacuggccagcaugaucugguuaucccccccaaugguuauuuuagauuugauuccugggucaaccaguucuacacacuugcccccaugggaaaugggacggggcguagacgugcauuauaa

SEQ ID NO: 5730 - RNA, 1623 nt, Artificial Sequence
  VP1__Norovirus__BAS30317
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuagaaccuguguugauccccuuacccgauguuaggaauaauuucuaucauuauaaucaaucaaaugaccccaccaucaaauugauagcaauguuguauacaccacuuagggcuaauaaugcuggggacgaugucuucacaguuucuugucgaguucuuacgagaccaucccccgauuuugauuucauauuuuuagugccacccacaguugaaucaagaacuaaaccauucucugucccaauuuuaacuguugaggagaugaccaauucaagguuccccauuccuuuggaaaaguuguucacgggccccaguaguaccuuuguuguucaaccacaaaacggcaggugcacgacugauggcgugcuccuagguacuacccaacugucuccugucaacaucugcaccuuuagaggggaugucacccacauugcaggcagucguaacuacacaaugaaucuggcuucccaaaauuggaacaguuaugacccaacagaagaaaucccagccccucuaggaacuccagauuucguggggaagauucaaggugugcucacccaaaccacaaggacagauggcucgacccgcggccacaaagcuacaguguacacugggagcgccgacuuuucuccaaaacuggguaggguucaauuugccacugacacagacaaugauuucgaugcuaaccaaaacacaaaguucaccccagucgguguuauccaggauggugguacugcccaccgaaaugaaccccaacaaugggugcucccaaguuacucaggcagaaauacucauaaugugcaccuggcccccgcuguagcccccacuuuuccgggugagcaacuccucuucuucagaucuaccaugcccggaugcagcggguaccccaacauggauuuggacugucugcuuccccaggaaugggugcaguauuucuaucaggaagcagccccagcacaaucugauguggcucugcuaagauuugugaauccagacacagguaggguuuuguuugaguguaagcuucauaaaucaggcuauguuacaguggcccacacuggccaacaugauuugguuaucccccccaaugguuauuuuagauuugauuccugggucaaccaguucuacacacuugcccccaugggaaaugggacggggcguagacgugcauuguaa

SEQ ID NO: 5731 - RNA, 1623 nt, Artificial Sequence; identical to SEQ ID NO: 5730
  VP1__Norovirus__BAS30320

SEQ ID NO: 5732 - RNA, 1623 nt, Artificial Sequence
  VP1__Norovirus__BAS30323
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugacuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaucauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggagaaguuguucacgggccccaguagugccuuuguuguucaaccacaaaacggcaggugcacgacugauggcgugcuccuagguacuacccaacugucucccgucaacaucugcaccuucagaggggaugucacccauauuucaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuagguagaguucaauuugccacugacacagacaaugauuuugaaacuaaccaaaacacaaaguucaccccagucggugucauccaggauggugguaccaccccccgaaaugaaccccaacaaugggugcucccaaguuacucaggcagaaacauucacaaugugcaccuggcccccgcuguagcccccacuuucccgggcgagcagcuccucuucuucagaucuacuaugcccggaugcagcggguaccccaacauggacuuggacugucugcucccccaggaaugggugcaguauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 5733 - RNA, 1623 nt, Artificial Sequence
  VP1__Norovirus__BAS30326
augaagauggcgucgagugacgccaacccaucugauggguccacagccaaccucgucccagaggucaauaaugagguuauggcuuuggagcccguuguuggugccgccauugcggcaccuguagcgggccaacaaaauguaauugaccccuggauuagaaacaacuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuuucagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugaccccaccauaaaguugauagcgauguuguauacaccacuuagggcuaauaaugcuggggacgaugucuucacaguuucuugucgaguucucacgagaccaucccccgauuuugauuucauauuucuagugccacccacaguugaaucaagaacuaaaccauucucugucccaauucuaacuguugaggagaugaccaauucaagguuccccauuccuuuggaaaagcuguucacgggccccaguaguaccuuuguuguucaaccacaaaacggcaggugcacgacugauggcgugcuccuagguaccacccaacugucuccugucaacaucugcaccuucagaggggaugucacccauauuacaggcagucauaacuauacaaugaaucuggcuucccaaaauuggaacaguuaugacccaacagaagagaucccagccccucuagggacuccagauuucguggggaagauucaaggcgugcucacccaaaccacaaggacggauggcucgacccgcggccacaaagcuacaguguacacugggagcgccgaauuuuccccaaaacuggguagaguucaauuugccacugacacaaacaaugauuuugaugccaaccaaaacacaaaguucaccccagucgguguuauccaggauggugguacuacccaccgaaaugaaccccaacaaugggugcuuccaaguuacucaggcagaaauacucacaaugugcaccuggcccccgcuguagcccccacuuuuccgggugagcagcuccucuuuuucaggucuaccaugcccggaugcagcggguaccccaacauggauuuggacugucuacucccccaggaaugggugcagcauuucuaccaggaggcagccccagcacaaucugauguggcucugcuaagauuugugaacccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 5734 - RNA, 1623 nt, Artificial Sequence; identical to SEQ ID NO: 5711
  VP1__Norovirus__BAS30329

SEQ ID NO: 5735 - RNA, 1623 nt, Artificial Sequence
  VP1__Norovirus__BAS30332
augaagauggcgucgagugacgccaacccaucugauggguccacagccaaccucgucccagaggucaauaaugagguuauggcuuuggagcccguuguuggugccgccauugcggcaccuguagcgggccaacaaaauguaauugaccccuggauuagaaacaacuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuuucagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugaccccaccauaaaauugauagcgauguuguauacaccacuuagggcuaauaaugcuggggacgaugucuucacaguuucuugucgaguucucacgagaccaucccccgauuuugauuucauauuucuagugccacccacaguugaaucaagaacuaaaccauucucugucccaauucuaacuguugaggagaugaccaauucaagguuccccacuccuuuggaaaagcuguucacgggccccaguaguaccuuuguuguucaaccacaaaacggcaggugcacgacugauggcgugcuccuagguaccacccaacugucuccugucaacaucugcacuuucagaggggaugucacccauauuacaggcagucauaacuauacaaugaaucuggcuucccaaaauuggaacaguuaugacccaacagaagagaucccagccccucuagggacuccagauuucguggggaagauucaaggcgugcucacccaaaccacaaggacggauggcucgacccgcggccacaaagcuacaguguacacugggagcgccgaauuuuccccaaaacuggguagaguucaaguugccacugacacaaacaaugauuuugaugccaaccaaaacacaaaguucaccccagucgguguuauccaggauggugguacuacccaccgaaaugaaccccaacaaugggugcuuccaaguuacucaggcagaaaugcucacaaugugcaccuggcccccgcuguagcccccacuuuuccgggugagcagcuccucuuuuucaggucuaccaugcccggaugcagcggguaccccaacauggauuuggacugucuacucccccaggaaugggugcagcauuucuaccaggaggcagccccagcacaaucugauguggcucugcuaagauuugugaacccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 5736 - RNA, 1623 nt, Artificial Sequence
  VP1__Norovirus__BAS30335
augaagauggcgucgagugacgccaacccaucugauggguccacagccaaccucgucccagaggucaauaaugagguuauggcuuuggagcccguuguuggugccgccauugcggcaccuguagcgggccaacaaaauguaauugaccccuggauuagaaauaacuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaagucaccauguucccccacauaauaguagauguuaggcaauuggaaccuguguugauccccuuacccgacguuaggaauaauuucuaccauuauaaucaaucaaaugaccccaccaucaaauugauagcaauguuguauacaccacuuagggcuaauaaugcuggggacgaugucuucacaguuucuugucgaguucucacgagaccaucccccgauuuugauuucauauuucuagugccacccacaguugaaucaagaacuaaaccauucucugucccaauucuaacuguugaggagaugaccaauucaagguuccccauuccuuuggaaaaguuguucacgggccccaguagugccuuuguuguucaaccacaaaacggcaggugcacgacugauggcguccuccuagguacuacccaacugucuccugucaacaucugcaccuucagaggggaugucacccacauugcaggcagucauaacuacacaaugaaucuggcuucccaaaauuggaacaguuaugacccaacagaagaaaucccagccccucuaggaacuccagauuucguggggaagauucaagguguacucacccaaaccacaaggacggauggcuccacccgcggccacaaagccacaguguacacugggagcgccgaauuuuccccaaaacuggguagaguucaauuugccacugacacaaacaaugauuuugaugcuaaccaaaacacaaaguuuaccccagucgguguuauccaggauggugguacuacccaccgaaaugaaccccaacaaugggugcuuccaaguuacucaggcagaaauacucauaaugugcaccuggcccccgcuguagcucccacuuuuccgggugagcagcuccucuucuucagaucuaccaugcccggaugcagcggguaccccaacauggauuuggacugucugcucccccaggaaugggugcaguauuucuaccaggaggcagccccagcacaaucugauguggcucugcugagauuugugaacccagacacagguaggguuuuguuugaguguaagcuucauaagucgggcuauguuacaguggcucacacuggccaacaugauuugguuaucccccccaaugguuauuuuagauuugauuccugggucaaucaguucuacacacuugcccccaugggaaacgggacggggcguagacgugcauuauaa

SEQ ID NO: 5737 - RNA, 1623 nt, Artificial Sequence
  VP1__Norovirus__BAS30338
augaagauggcgucgagugacgccaacccaucugaugggucuacagccaaccucgucccagaggucaacaaugagguuauggcuuuggagcccguuguuggugccgccauugcggcaccuguagcgggccaacaaaauguaauugaccccuggauuagaaauaauuuuguacaagccccugguggagaguucacaguauccccuaggaacgcuccaggugaaauacuauggagcgcgccccuaggcccugauuugaauccuuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccagguuacuauguucccccacauaauaguagauguuaggcaacuggaaccuguguugauccccuuacccgauguuaggaauaauuucuaucacuacaaucaaucaaaugaccccaccaucaaauugauagcaauguuguacacaccacuuagggcuaauaaugcuggggacgaugucuucacaguuucuugucggguacucacgagaccaucccccgauuuugauuucauauuuuuagugccacccacaguugaaucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgacugauggcgugcuccuagguaccacccaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucgugggaaagauccaaggugugcucacccaaaccacgagggcagauggcucgacccguggacacaaagcuacaguguacacugggagcgccgacuuugcuccaaaacuggguagaguucaauuugccacugacacagacaaugauuuugaugcuaaccaaaacacaaaguucaccccagucggugucauccaggauggugauacugcccaccgaaaugaaccccaacaaugggugcucccaaguuacucagguagaaauagucacaaugugcaccuggcccccgcuguagcccccacuuuuccgggugagcaacuucucuucuucagauccacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugaucugguuaucccccccaaugguuauuuuagauuugauuccugggucaaccaguucuacacacuugcccccaugggaaauggaacggggcguagacgugcauuauaa

SEQ ID NO: 5738 - RNA, 1623 nt, Artificial Sequence
  VP1__Norovirus__BAS30341
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuuaggcccugauuugaaucccuaccuuucucauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguacacaccacuuagggcuaauaaugccggggaugaugucuucacaguuucuugucgaguucuuacgagaccaucccccgauuuugauuucauauuuuuggugccacccacaguugaaucaagaacuaaaccauucucugucccaguuuuaacugucgaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacuggaagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcuaccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 5739 - RNA, 1623 nt, Artificial Sequence
  VP1__Norovirus__BAS30344
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaucaauuuuguacaagccccugguggagaguuuacaguauccccuagaaacgcuccaggugaaaucuuauggagcgcgcccuuaggcccugauuugaaucccuaccuuucucauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaauuggaaccuguguugauccccuuacccgauguuaggaauaauuucuaccauuauaaucaaucaaaugaccccaccaucaaauugauagcaauguuguacacaccacuuagggcuaauaaugccggggaugaugucuucacaguuucuugucgaguucuuacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacuggaagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcuaccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 5740 - RNA, 1623 nt, Artificial Sequence
  VP1__Norovirus__BAS30347
augaagauggcgucgagugacgccaacccaucugauggguccacagccaaccucgucccagaggucaacaaugagguuauggcuuuggagcccguaguuggugccgccauugcggcaccuguagcgggccaacagaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccgacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggacgucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccagcaugauuugguuaucccccccaaugguuauuuuagauuugauuccugggucaaccaguucuacacacuugcccccaugggaaaugggacggggcguagacgugcauuauaa

SEQ ID NO: 5741 - RNA, 1623 nt, Artificial Sequence
  VP1__Norovirus__BAS30350
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccaggauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuauucaggcagaaacauucacaaugugcaccuggcccccgcuguagcccccacuuucccgggcgagcagcuccucuucuucagaucuacuaugcccggaugcagcggguaccccaacauggacuuggacugucugcucccccaggaaugggugcaguauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 5742 - RNA, 1623 nt, Artificial Sequence
  VP1__Norovirus__BAS30353
augaagauggcgucgagugacgccaacccaucugauggguccacagccaaccucgucccagagguuaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucucauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaauuaaaugaccccaccaucaaauugauagcaauguuguacacaccacuuagggcuaauaaugccggggaugaugucuucacaguuucuugucgaguucuuacgagaccaucccccgauuuugauuucauauuuuuggugccacccacaguugaaucaagaacuaaaccauucucuguuccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacuggaagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcuaccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaauguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 5743 - RNA, 1623 nt, Artificial Sequence
  VP1__Norovirus__BAS30356
augaagauggcgucuagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgagcccuuaggcccugauuugaaucccuaccuuucccauuuggccagaauguauaaugguuaugcaggugguuuugaagugcagguaauccucgcggggaacgcguucaccgccgggaaaaucauauuugcagcagucccaccaaauuucccaacugaaggucugagccccagccaggucacuauguucccccacauaauaguagauguuaggcaauuggaaccuguguugauccccuuacccgauguuaggaauaauuucuaccauuauaaucaaucaaaugauuccaccaucaaauugauagcaauguuguacacaccacuuagggcuaauaaugccggggacgaugucuucacaguuucuugccgaguucucacgagaccaucccccgauuuugauuucauauuuuuggugccacccacaguugagucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggagaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaaugguucgacccgcggccacaaagcuacaguguacacugggagcgccgacuuuucuccaaaacuggguagaguccaauuugccacugacacagacaaugauuuugaaacuaaccaaaacacaaaguucaccccagucgguguuauccaggauggugguacuacccaccgaaaugaaccccaacaaugggugcuuccaaguuacucaggcagaaacauucauaaugugcaccuggcccccgcuguagcccccacuuucccgggcgagcagcuccucuucuucagaucuacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugagugcaagcuucauaaaucaggcuauguuacaguggcucacacuggccaacaugauuugguuaucccccccaaugguuauuuuagauuugauuccuggguuaaccaguucuacacacuugcccccaugggaaaugggacggggcguagacgugcauuauaa

SEQ ID NO: 5744 - RNA, 1623 nt, Artificial Sequence
  VP1__Norovirus__BAS30359
augaagauggcgucuagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauauuauggagcgcgcccuuaggcccugauuugaaucccuaccuuucccauuuggccagaauguauaaugguuaugcaggugguuuugaagugcagguaauccucgcggggaacgcguucaccgccgggaaaaucauauuugcagcagucccaccaaauuucccaacugaaggucugagccccagccaggucacuauguucccccacauaauaguagauguuaggcaauuggaaccuguguugauccccuuacccgauguuaggaauaauuucuaccauuauaaucaaucaaaugauuccaccaucaaauugauagcaauguuguacacaccacuuagggcuaauaaugccggggacgaugucuucacaguuucuugccgaguucucacgagaccaucccccgauuuugauuucauauuuuuggugccacccacaguugagucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggagaugucacccauauuucaggcagucguaacuacacaaugaauuuggccucccaaaauuggaacaguuacgauccaacagaagaaaucccagccccucuaggaacuccagauuucguggggaagauucaaggugugcucacccaaaccacaaggacaaaugguucgacccgcggccacaaagcuacaguguacacugggagcgccgacuuuucuccaaaacuggguagaguccaauuugccacugacacagacaaugauuuugaaacuaaccaaaacacaaaguucaccccagucgguguuauccaggaugguaguacuaccccccgaaaugaaccccaacaaugggugcuuccaaguuacucaggcagaaacauucauaaugugcaccuggcccccgcuguagcccccacuuucccgggcgagcagcuccucuucuucagaucuacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugagugcaagcuucauaaaucaggcuauguuacaguggcucacacuggccaacaugauuugguuaucccccccaaugguuauuuuagauuugauuccuggguuaaccaguucuacacacuugcccccaugggaaaugggacggggcguagacgugcauuauaa

SEQ ID NO: 5745 - RNA, 1623 nt, Artificial Sequence
  VP1__Norovirus__BAS30362
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauauuauggagcgcgcccuuaggcccugaucugaaucccuaccuuucccauuuggccagaauguacaaugguuaugcgggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaauuggaaccuguguugauccccuuacccgauguuaggaauaauuucuaccauuauaaucaaucaaaugaccccaccaucaaauugauagcaauguuguacacaccacuuagggcuaauaaugcuggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuucccauuccuuuggaaaaguuguucacgggccccagcagugccuuuguuguucaaccacaaaauggcaggugcacgacugauggcgugcuccuagguacuacccaacuguccccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 5746 - RNA, 1623 nt, Artificial Sequence
  VP1__Norovirus__BAS30365
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaauuauauuugcagcagucccaccaaacuucccaacugaagguuugagccccagccaggucacuauguucccccacauaauaguagauguuaggcaauuggaaccuguguugauccccuuacccgauguuaggaauaacuucuaccauuauaaucaaucaaaugaccccaccaucaaauugauagcaauguuguacacaccacuuagggcuaauaaugccggggacgauguuuucacagucucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugcuuucguuguucaaccacaaaacggcaggugcacgacugauggcgugcuccuagguacuacccaacugucuccugucaacaucugcaccuucagaggggaugucacccauauuucaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccaccgauacagacaaugauuuugaaacuaaccaaaacacaaaguucaccccagucgguguuauucaggauggcaguacuaccccccgaaaugaaccccaacaaugggugcucccaaguuauucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguauuucuaccaggaggcagccccagcacaaucugauguggcucuguugagauuugugaauccagacacagguaggguuuuguuugaguguaagcuucauaaaucaggcuauguuacaguggcucacacuggccaacaugauuugguuauccccccuaaugguuauuuuagauuugauuccugggucaaccaguucuacacacuugcccccaugggaaaugggacggggcgcagacgugcauuauaa

SEQ ID NO: 5747 - RNA, 1623 nt, Artificial Sequence
  VP1__Norovirus__BAS30368
augaagauggcgucuagugacgccaacccaucugauggguccacagccaaccucgucccagaggucaacaaugagguuauggcuuuggagcccguaguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaauccuuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaaugcuguacacaccacuuagggcuaauaaugccggggacgaugucuucacaguuucuugucgaguccucacgagaccaucccccgauuuugauuucauauuuuuggugccacccacaguugaaucaagaacuaaaccauuuucugucccaguuuuaacuguugaggagaugaccaauucaagguuccccauuccuuuggaaaaguuguucacgggccccaguagugccuuuguuguucaaccacaaaacggcaggugcacgacugauggcguacuccuagguacuacccaacugucuccugucaacaucugcaccuucagaggggaugucacccauaucccaggcagucguaacuacacaaugaauuuggcuucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauucauaaugugcaccuggcccccgcuguagcccccacuuuuccgggcgagcagcuccucuucuucagaucuacuaugcccggaugcagcggguacccuaacauggauuuggacugucugcucccccaggaaugggugcaguauuucuaccaggaggcagccccagcacaaucugauguggcucuguugagauuugugaauccagauacagguaggguuuuguuugaguguaagcuccauaaaucaggcuauguuacaguggcucacacuggccaacacgauuugguuaucccccccaaugguuauuuuagauuugauuccugggucaaccaguucuacacacuugcccccaugggaaaugggacggggcguagacgugcauuauaa

SEQ ID NO: 5748 - RNA, 1623 nt, Artificial Sequence
  VP1__Norovirus__BAS30371
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucucauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaauuggaaccuguguugauccccuuacccgauguuaggaauaauuucuaccauuauaaucaaucaaaugaccccaccaucaaauugauagcaauguuguacacaccacuuagggcuaauaaugccggggaugaugucuucacaguuucuugucgaguucuuacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacuggaagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcuaccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 5749 - RNA, 1623 nt, Artificial Sequence
  VP1__Norovirus__BAS30374
augaagauggcgucuagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucugaaucccuaucuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccagguuacuauguucccccacauaauaguagauguuaggcaauuggaaccuguguugauccccuuacccgauguuaggaauaauuucuaccauuauaaucaaucaaaugaccccacuaucaaauugauagcaauguuguacacaccacuuagggcuaauaaugcuggggacgacgucuucacaguuucuugucgaguccucacgagaccuucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaauggcaggugcacgacugauggcgugcuccuagguacuacccaacuguccccugucaacaucugcaccuucagaggggaugucacccauauuacaggcagucguaacuacacaaugaauuuggccucccaaaauuggaacaguuacgacccaacagaagaaaucccagccccucuaggaacuccagauuucguggggaagauccaaggugugcucacccaaaccacaaggacaaauggcucgacccgcggccacaaagcuacaguguacacugggagcgccgacuuuucuccaaaacuggguagaguucaauuugccacugacacagacaacgauuuugaagcuaaccaaaacacaaaguucaccccagucgguguuauccaggaugguaguaccaccccccgaaacgaaccccaacagugggugcucccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcccacacuggccaacaugauuugguuaucccccccaaugguuauuuuagauuugauuccugggucaaccaguucuacacacuugcccccaugggaaaugggacggggcguagacgugcauuauaa

SEQ ID NO: 5750 - RNA, 1623 nt, Artificial Sequence
  VP1__Norovirus__BAU16297
augaagauggcgucgaaugacgacaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucacugccgggaaggucauauuugcagcagucccaccaaauuuuccaacugaaggcuugagccccagccaggucacuauguucccccauauaguaguagauguuaggcaacuagaaccuguguugauucccuuacccgaugucaggaauaauuucuaucauuacaaccaaucaaaugaccccaccauuaaguugauagcaaugcuguauacaccacuuagggcuaauaaugcuggggaugaugucuucacaguuucuugccgaguucucacgagaccaucccccgauuuugauuucauauuucuagugccacccacagucgagucaagaacuaaaccauucucugucccaguuuuaacuguugaggagaugaccaauucaagauuccccauuccuuuggaaaaguuguucacgggucccagcagugccuuuguuguccaaccacaaaaugguaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccagucggugucauccaagaugguggcaccacccaccgaaaugaaccccaacagugggugcucccaaguuacucaggcagagauacucauaaugugcaucuggcccccgcuguagcccccacuuuuccgggugagcaacuucucuucuucagauccaccaugcccggauguagcggguaccccaacauggauuuggacugucugcucccucaggaaugggugcaguacuucuaccaagaggcagccccagcacaaucugauguggcccugcuaagauuugugaauccagacacagguaggguuuuguucgaguguaagcuucauaaaucaggcuauguuacaguggcucacacuggccaacaugauuugguuaucccccccaaugguuauuuuagguuugauuccugggucaacaaguuuuacacgcuugcucccaugggaaauggaacggggcguagacgugcaguauaa

SEQ ID NO: 5751 - RNA, 1623 nt, Artificial Sequence
  VP1__Norovirus__BAU16299
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaauauaauugaccccuggauuagaauaaauuuugugcaagcaccaaauggagaguucacagugucacccagaaacucuccuggagaaauuuuauuaaauuuagaguugggcccugauuugaacccuuauuuggcucauuugucaaggguguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaauagccgcaugagauuaguggcuaugcucuauaccccacucagaucuaauggcucaggugaugaugucuuuacugucucuugcaggguuuugacuaggcccacuccugauuuugaguucacuuauuuagugccaccuucuguugaaucuaaaacuaagccuuuuuccuuaccuauuuuaacccuuucugagcucacaaauucgagguuuccaguccccaucgauucgcucuucaccgcccaugauaacguguggcaggugcagugucaaaauggcagguguacacuugauggugaguuacaaggcacaacccaguugcucccaacuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaauggaaacugggaaugggcgaaggagggcucaguaa

SEQ ID NO: 5752 - RNA, 1635 nt, Artificial Sequence
  VP1__Norovirus__BAU16301
augaugauggcgucuaaggacgcugcaccaagcgcagauggcgccacuggcgccggccagcugguaccggagguuaauacagcugacccuauacccauugacccuguggcugguuccucuacagcacuugccacugcaggccaaguuaauuugauugaucccuggauaaucaauaauuuugugcaagccccccagggugaauucacaauauccccaaacaauacccccggugaugugcuuuuugauuugcaguuaggaccucauuuaaacccuuuccucucccaucucucucagauguacaauggcugggugggcaacaugcgagugcguguugucuuggcugguaaugcuuucacggcugggaagguuauaauuuguuguguccccccuggcuuucaaucucguacucuuuccauagcucaggcuacuuuauucccccacguuauugcugauguuaggacccuugaccccguagaagugccucuugaagaugucaggaacguguuguaucauaauaaugacacccaacccaccaugcgccuccuuugcaugcuguauaccccucuccgcaccggaggagcgucuggugggacugauucuuucgugguagcugggcguguacuuacuugcccaggcccugacuuuaauuucuuauucuuggucccuccuacagucgagcaaaagacucgcccauucacugugccuaauaucccuuugaaguaucugucuaacuccagaaucccaaaccccauugaagguaugucauugucaccugaucagacucaaaauguccaauuccaaaauggcaggugcacaauugacggucaaccccucgggacuacaccugucucgguuagccaguuauguaaguuuagggguaggauuacaucuggacagaaggugcucaauuugacagaguuggaugguucaccuuuuauggccuuugcugccccugccccugugggcuucccagaucuuggguccugugauuggcauauugagaugaguaaaaucccaaauucuagcacccagaguaauccaauaguggucaauucugucaagcccaauagucaacaguuugucccucacuugucaagcauuacccuugaugacaauguuucuagugggggugauuauauugguacuauacaauggaccucuccuccuucugguucuggcggagccaauacaaacuuuuggaaaaucccugacuaugggucuagcuuggcugaagcuucacaguuggcccccgcugucuauccaccugguuucaaugaagugauuguguauuuuauggcaucuauaccuggccccaaucaaucuggguccccuaacuuggugccaugccuacucccccaggaauauauaacacauuucauuagugagcaggcccccauucagggugaggcugccuuacuccauuauguggacccagauaccaaucguaauuugggugaguuuaaauuguauccuggugguuauuuaaccuguguuccuaauaguucuaguacuggaccucaacagcuuccucuugaugguguuuuugucuuugcuucuugggucucuagauuuuaucaauuaaagccugugggaacagccggaccggcuagagguaggcuugguguccguagauaa

SEQ ID NO: 5753 - RNA, 1623 nt, Artificial Sequence
  VP1__Norovirus__BAU16303
augaugauggcgucuaaggacgucccaacaucgccugauggcgccaguggcgcuggccagcuagugccggagguuaauacagcugaccaaauuucaauggacccuguugcaggugcuuccacugcaguugcaacagcugggcaaguuaauaugauugauccauggauauucaauaauuuuguccaggccccccagggugaauuuacuauuuccccaaauaauacccccggugacauuuuguuugauuuacaauuaggcccccaucugaaucccuucuuagcucauuuaucacagauguauaauggauggguuggcaacaugcggguucgcauauugcuggcaggcaaugcuuucacagcugguaagauaaucauauguuguguuccccccggcuuugaugcuagaauacuuacuauugcucaagcuacucuauucccucacuugauugcugauguuagaacucuugaaccaguagaauuaccucucgaggaugugcgcaacguccucuaccacaacagcagccagccacaaccaaccaugcggcugguagcuaugcuauacaccccacugcguacaggcggugggucuggaggcacugaugcuuuugugguugcugggagagugcugacauguccugcaccagauuuuaguuuucuguuucuuguuccucccucuguagagcaaaagacuaggguuuucaguguacccaauauaccacucaaggaucucucaaacuccagagugccaaccuugauucaaggcauguuuguuucuccugauguuaaucaaucagugcaauuccaaaaugggcggugccaaauugauggccagcugcaaggcaccaccccagugucccucagccaauuauguaagaucagagguaagacuuccaguaauaccagaguacuuaaucuuagugagguugaugggacaccuuuugugccccuugaguccccugcaccuguagguuucccagauauaggcgggugugauuggcaugucggcuucacuuuugaggcacgagaccagggccccucccagaaugugaccuuugcaacuaaugauucuagcuuugugccauaucuuggcaguauuucaccccauaauggugauggguuccauaguggugauauuauagguaguuuagauuggaucucagcuccaucggaugguucugcacuugaugugugguccauaccaaaauauggaucaucucucccagauguuacccaucuagcuccugcagucuuucccccuggcuuuggugagguuauccucuacuuccauucuaaauuuccugguucugguccuacugauaaacuuagggucccaugucugaugccacaagaguucauaacacacuuuugugaugagcaagcacccauagcgggggaggcugcccuccuucacuauguggauccugacgcaggcaggaacuuaggggaguuuaagcuuuauccagauggcuuuaugacgugugugcccaacagcaucagcaguggcccccagacucugccaaucaaugguguguuuguauuuguguccuggguauccagauuuuaccaacuuaagccugugggaacggccucuauggccaggaggcuuggucuucggcgcauauaa

SEQ ID NO: 5754 - RNA, 1647 nt, Artificial Sequence
  VP1__Norovirus__BAU16305
augaagauggcgucgaaugacgccacuccaucuaaugauggugccgccggccucgucccagagaucaacaaugaggcaauggcgcuagauccaguggcgggugcagcgauagcagcaccucucacuggucagcaaaauauaauugaucccuggauuaugaauaauuuugugcaagcaccugguggugaguuuacaguguccccuaggaauuccccuggugaagugcuucuuaauuuggaauuggguccagaaauaaaccccuauuuggcccaucuugcuagaauguauaaugguuaugcagguggauuugaagugcagguaguccuagcuggaaaugcguuuacagcaggaaagauaaucuuugcagcuauaccccccaauuuuucaacugauaaucugagcgcagcacagaucacaaugugcccacaugugauuguggaugucagacaguuggaaccagucaaccucccgaugcccgacguucgcaacaacuucuuccauuacaaucaagggucugauucgagauugcgcuuaauugcaaugcuguauacaccucuuagggcaaauaauucuggugaugauguuuuuacugugucuuguagagugcugacuaggccuagcccugacuucucauuuaauuuccuugugccaccuacuguggagucaaagacaaaacccuuuacucucccuauucugacuauuucugaaauguccaauucuagguuuccagugccgauugauucucugcacaccagcccaacugagaauguugucguccagugccaaaaugggcgcgucacucuugauggugaguugaugggcaccacccaacuccuacccagucaaaucugugcuuucaggggcgugcuuaccagaucaacaagcagggccagugaccaggccgacacagcagccccuagguuguuuaauuauuauuggcacauacaauuggauaaucuaaauggaacucccuaugacccugcagaagacauaccaggcccccuagggacgccagauuuucggggcaaagucuuuggcguggccagccagagaaaccccgacagcacaacuagagcacaugaagcaaagguggacacaacagcuggucguuucaccccaaaacuaggcucauuagagauauccacugaaucugaugacuucgaccaaaaccaaccaacaagauucaccccaguuggcauugggguugaccaugaagcggauuuccaacaauggucuuugcccgacuauucuggucaguucacccacaacaugaacuuagccccagcuguugcucccaacuucccuggugagcagcuccucuucuuccgcucacaguuaccauccucuggugggcgauccaacgggauucuagacugccuggucccccaagaguggguucagcacuucuaccaagaaucggcccccgcucaaacucaaguggcccugguuagguaugucaacccugacacugguagaguauuguuugaggccaagcugcacaaauuagguuucaugacuauagcuaagaauggugauucuccaauaauugucccuccagauggauacuuuagguuugaaucuugggugaacccauuuuauacacuugcccccaugggaauugggaaugggcguagaaggauucaauaa

SEQ ID NO: 5755 - RNA, 1671 nt, Artificial Sequence
  VP1__Norovirus__BAU16306
augaagauggcgucgagugacgcugcuccaucugcggauggugcgggcaaccucgucccagagagucaacaagagguauugccccucgcccccguugcgggcgcugcacuagcggcacccguaguggggcagacaaacauaauugaccccuggauuaaagaaaauuuuguucaagccccccagggugaguuuacagucucaccuaaaaauucuccuggugaaauuuuagucaauuuggaauugggacccaaacucaaccccuaucuggaucaccucucacgcauguacaauucauaugcuggugguauagauguuauggugguguuggcggguaacgccuucacagccgguaagguucuaauagcagccauccccccaaauuuuccaguagaaggaguguccgccucccaggccacucaguucccccaugugaucauagauguuagaacacuugacccugugcgucuuccacucccagacgugcggucuacauucuuccauuacaccaaugacacugaaccaaaaaugagguugguuauuuggcucuauaccccacuuagaacuaauggcaguggugaugauucuuucaccgucucugggcgcauacucacaaggcccucccaggauuuugaguuugcauuccuuauucccccaacaguggaaacaaagacaacccccuuuucagugccaggcuucucagugcaggagauguccaacucuagguggccggccgccaucucugcgaugguuguccgaggaaaugagccccagguuguccaguuccagaaugguagggcccaccuggaugguauguuacuugguacgacacccgugucgcccaacuacauagcauccuaucgagguauuuccaccggcaacucucgcucugcuuccccugaagccgacgagagggcuguuggcagcuucgauguguggauccgcuuacaagaaccugauggacagcccuaugacaucuuuggcaaacagccagccccaauuggcaccccugacuucaaggccgugauaguuggcuuugcagcuaggccccucacauccggguccuacgcaaacgaagcguauguuaacaccacagccagugacuaugccccagccacugguaacaugcgcuucacggucaggaaugguggguccgggcacauaucugcaaacaaauacugggaguucaaaucauuugguguugaaggagagaggcacacugacauccaguaucaggaguacgagcuuccugauuacucuggccagguugcuuccaaccacaaccuggccccccccguggccccacgcaugccuggugagucucuauugcuuuuccaaucaaauaugccugugugggacgaugggcauggugaguccacacccaagaagauccacugccugcugccacaagaauucauuggccacuucuuugauaaacaggcccccucccuaggugaugcugcauugcucagguaugucaaucaagagacaaacagggugcuguuugagugcaaacuuuauagggaugguuacaucacuguugcugcaucaucaggguugcuagauuuccccuuggauggauucuuuagguuugauucuuggguuaguucuuucuacauuuuauccccugugggaagcggccaaggccgaagggguagagugagguuucaauaa

SEQ ID NO: 5756 - RNA, 1626 nt, Artificial Sequence
  VP1__Norovirus__BAU16307
augaugauggcgucuaaggacgcuacaccaagcgcagauggcgcgaauggcgccggucagcucgugccggagguuaacaaugcugaaccacugccucuugacccuguggcuggggcuucuacugcucuagccacugcuggucaagucaauaugauugacccuuggauuuucaauaauuuuguccaagccccucagggugaauucacaaucuccccuaacaauacccccggugauauauuguuugauuugcaauuaggaccucaucuuaaucccuuccuugcccauuugucucaaauguauaaugguugggucgguaacaugcgagucagggucauccuggcgggcaacgcauuuacugccgguaaagugauaauuuguuguguccccccugguuuucaauccaggacccuaucaauugcucaggcuacucuuuucccucaugugauugcugauguucguacauuggaaccacuugaaaucccauuagaggaugucaggaacacauuguaucacaacaaugauagccagccgacaaugcgcuuauugugcaugcuguacacgccacuccguacugguggcgguucuggcggcacagacgcguuugucguugcagggagagucuuaaccuguccaaguccugacuucaauuuucucuuccuagucccaccgacuguggaacagaagacacguccuuuuagugugcccaauaucccacuucagaaucuuuccaauucucgaguuccuagucugauccaaagcaugguucucucuagugaccaugcgcaaacaguccaauuucagaaugguagguguacuacugacggucaucugcuagggaccaccccuguuucuucuggucaacucaugaaauuuaggggcaaagugacuccagguucgaaggugcugaaccuaacagaacuagaugguucaccauuccuggccuuugagcccccagccccugcuggauucccugaucuuggaaagugugauuggcauauugaaaugagucucuaucagguuaacaaucaagauaaccccauuguguugcgugcuauugaaccuaauucaucuucuuuuguaccgcaccuugguaguguuucuuuuaaucagaauguugaugcagcuggugauuauguuuguacuauacaguauacuucacccccuuccaauucucaugaugcugauguugauuucuggucuaucccugauuaugguucuaauuuggcugaggcaucgcagcuugcuccaguuguuuaccccccugguuuuggugaagcuauugucuauuucaugucacguguccccggcuggaauagaacuaauaggcucaaucuggucccuugccuauugccccaagaguucauugggcacuuugucagugaacaagcccccgcaauuggugaggccgcccucuuacauuauguugacccagacaccaaucgaaaccugggugaauucaaauuguauccugagggcuuuaucaccuguguccccaauggcacugguccucagcagcucccccugaauggagucuuugucuuuucuuccuggguaucaagguuuuaucaacucaagccugugggaacggcuucuucagccagagguagacuuggcauuaggagauaa

SEQ ID NO: 5757 - RNA, 1623 nt, Artificial Sequence
  VP1__Norovirus__BAU24831
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauuuuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagacgucacccauaucacagguagucguaacuacacaaugaauuuggcuucucaaaauuggagcaauuaugacccaacagaagagaucccagccccucuaggaacuccagauuuuguggggaagauucaaggcgugcucacccaaaccacaaggacagauggcucaacacguggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5758 - RNA, 1623 nt, Artificial Sequence
  VP1__Norovirus__BAU24834
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgcugggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccacuauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcuuccaaguuacucaggcagaaauacuccuaaugugcaucuggcccccgcuguagcccccacuuuuccgggugagcaacuucucuucuucagauccaccaugcccggaugcagcggguaccccaacauggacuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5759 - RNA, 1623 nt, Artificial Sequence
  VP1__Norovirus__BAU24837
augaagauggcgucgagugacgccaacccaucugauggguccgcagccaaccucgucccagaggucaacaaugaggucauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugacuccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacuaucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuuguuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuguaa

SEQ ID NO: 5760 - RNA, 1623 nt, Artificial Sequence
  VP1__Norovirus__BAU24840
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaaucuuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgacuuugauuucauauuucuagugccacccacaguugagucaagaacuaaaccauucucugucccaguuuuaaccguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcacccucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaaugggacggggcguagacgugcacuauaa

SEQ ID NO: 5761 - RNA, 1623 nt, Artificial Sequence
  VP1__Norovirus__BAU24843
augaagauggcgucgagugacgccaacccaucugauggguccgcagccaaccucgucccagaggucaacaaugagguuauggcucuggagcccguugucggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccacauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugacuucauauuucuagugccacccacaguugagucaagaacuaaaccauucucugucccaguuuuaacuguugaggagaugaccaauucaagauuccccauuccuuuggaaaaguuguucacgggacccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuccauaagucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5762 - RNA, 1623 nt, Artificial Sequence
  VP1__Norovirus__BAU24846
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucaucuggccagaauguauaaugguuaugcaggugguuuugaagugcaggugauucucgcggggaacgcguucaccgccggaaaaauuauauuugcagcagucccaccaaauuuuccaacugaaggcuugagucccagucaggucaccauguucccccauauaauaguggauguuaggcaauuggaaccuguguugauccccuuaccugauguuaggaauaauuucuaccacuauaaucagucaaaugauucuaccauuaaauugauagcaaugcuguauacaccacuuagggcuaauaaugcuggggaagaugucuucacagucucuugucgaguucucacgaggccauccccugauuuugauuucauauuuuuggugccaccuacaguugagucaagaacuaagccauuuacugucccaauccuaacuguugaagaaaugaccaacucaagguuccccauuccuuuggagaaguuguucacgggucccagcagugccuuuguuguucaaccacaaaauggcagaugcacaacugauggcgugcucuuagguaccacccagcugucuccugucaacaucugcaccuucagaggggaugucacccacauugcagguucucguaauuauacaaugaauuuggcuucucuaaauuggaacaacuaugacccaacagaagaaauuccagccccucuaggaacuccagauuucgugggaaagauccaagguaugcucacucaaaccacaaagggagauggcucgacccguggccauaaagcuacaguuuacacugggagugcccccuucacuccaaagcugggcaguguccaauucgaaacugacacagaaaaugauuuugaaacccaccaaaacacaaaauucaccccagucggugucauccaggaugguggcaccacccaccgaaaugaaccucaacaaugggugcucccgaguuauucagguagaaaugucccuaauguacaccuagccccugcuguagcccccacuuuuccgggugaacaacuccuuuucuuuagguccauuaugcccggaugcagcggguaucccaacauggacuuggacugccugcuaccccaggagugggugcagcacuucuaccaagaggcagcuccagcacaaucugauguggcucuauugagauuugugaauccagacacggguaggguccuguuugagugcaaacuucauaagucaggcuaugucacaguggcccauaccggccagcaugauuuggucaucccccccaaugguuauuuuagguuugauuccuggguuaaccaauucuauacgcuugcccccaugggaaacggaacggggcguagacgugcuuuguaa

SEQ ID NO: 5763 - RNA, 1623 nt, Artificial Sequence
  VP1__Norovirus__BAU24849
augaagauggcgucgagugacgccaacccaucugauggguccgcagccaaccucgucccagaggucaacaaugaggucauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguccucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacuaucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuguaa

SEQ ID NO: 5764 - RNA, 1623 nt, Artificial Sequence
  VP1__Norovirus__BAU24852
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuauaaucaaucaaaugaccccaccauuaaguugauagcaauguuguauacaccacuuagggcuaauaaugcuggggaugaugucuucacaguuucuugccgaguccucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggccccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagacuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccagucggugucauccaagacgguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuauuccccccaaugguuauuuuagauuugauuccugggucaaccaguucuacacgcuugcccccaugggaaauggaacggggcguagacgugcaguauaa

SEQ ID NO: 5765 - RNA, 1623 nt, Artificial Sequence
  VP1__Norovirus__BAU24855
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucaucuggccagaauguauaaugguuaugcaggugguuuugaagugcaggugauucucgcggggaacgcguucaccgccggaaaaauuauauuugcagcagucccaccaaauuuuccaacugaaggcuugagucccagucaggucaccauguucccccauauaauaguggauguuaggcaauuggaaccuguguugauccccuuaccugauguuaggaauaauuucuaccacuauaaucagucaaaugauucuaccauuaaauugauagcaaugcuguauacaccacuuagggcuaauaaugcuggggaagaugucuucacagucucuugucgaguucucacgaggccauccccugauuuugauuucauauuuuuggugccaccuacaguugagucaagaacuaagccauuuacugucccaauccuaacuguugaagaaaugaccaacucaagguuccccauuccuuuggagaaguuguucacgggucccagcagugccuuuguuguucaaccacaaaauggcagaugcacaacugauggcgugcucuuaggcaccacccagcugucuccugucaacaucugcaccuucagaggggaugucacccacauugcagguucucguaauuacacaaugaauuuggcuucucuaaauuggaacaacuaugacccaacagaagaaauuccagccccucuaggaacuccagauuucgugggaaagauccaagguaugcucacucaaaccacaaagggagauggcucgacccguggccauaaagcuacaguuuacacugggagugcccccuucacuccaaagcugggcaguguucaauucgaaacugacacagaaaaugauuuugaaacccaccaaaacacaaaauucaccccagucggugucauccaggaugguggcaccacccaccgaaaugaaccucaacaaugggugcucccgaguuauucagguagaaaugucccuaauguacaccuagccccugcuguagcccccacuuuuccgggugaacaacuccuuuucuuuagguccauuaugcccggaugcagcggguaucccaacauggacuuggacugccugcuaccccaggagugggugcagcacuucuaccaagaggcagcuccagcacaaucugauguggcucuauugagauuugugaauccagacacggguaggguccuguuugagugcaaacuucauaagucaggcuaugucacaguggcccauaccggccagcaugauuuggucaucccccccaaugguuauuuuagguuugauuccuggguuaaccaauucuauacgcuugcccccaugggaaacggaacggggcguagacgugcuuuguaa

SEQ ID NO: 5766 - RNA, 1623 nt, Artificial Sequence
  VP1__Norovirus__BAU24858
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuucguuguccaaccacaaaacgguaggugcacgacugauggcgugcuccuaggcacuacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5767 - RNA, 1623 nt, Artificial Sequence
  VP1__Norovirus__BAU24861
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaaucuuauggagcgcgcccuugggcccugaucugaaucccuaccuaucucauuuggccagaauguauaaugguuaugcaggugguuuugaagugcaggugauucucgcggggaacgcguucaccgccggaaaaaucauauuugcagcagucccaccaaauuuuccaacugaaggcuugagucccagucaggucaccauguucccccauauaauaguggauguuaggcaauuggaaccuguguugauccccuuaccugauguuaggaauaauuucuaucauuauaaucagucaaaugauucuaccauuaaauugauagcaaugcuguauacaccacuuagggcuaauaaugcuggggaagaugucuuuacagucucuugucgaguucucacgaggccauccccugauuuugauuucauauuuuuggugccaccuacaguugagucaagaacuaagccauuuacugucccaaucuuaacuguugaagaaaugaccaacucaagguuccccauuccuuuggagaaguuguucacgggucccagcagugccuuuguuguucaaccacaaaauggcagaugcacaacugauggcgugcucuuaggcacuacccagcugucuccugucaacaucugcaccuucagaggggaugucacccacauugcagguucucguaauuacacaaugaauuuggcuucucuaaauuggaacaauuaugacccaacagaagaaauuccagccccucuaggaacuccagacuucgugggaaagauccaagguaugcucacucaaaccacaaagggagauggcucgacccguggccauaaagcuacaguuuacacugggagugcccccuucacuccaaagcugggcaguguccaauucgaaacugacacagaaaaugauuuugaaacccaccaaaacacaaaauucaccccaguuggugucauccaggaugguggcaccacccaccgaaaugaaccucaacagugggugcucccaaguuauucagguagaaaugucccuaauguacaccuagccccugcuguagcccccacuuuuccgggugaacaacuccuuuucuuuagguccacuaugcccggaugcagcggguaucccaacauggacuuggacugccugcuaccccaggagugggugcagcacuucuaccaagaggcagcuccagcacaaucugauguggcucuauugagauucgugaauccagacacggguaggguccuguuugagugcaaacuucauaaaucagguuaugucacaguggcccacaccggccagcaugauuuggucaucccccccaaugguuauuuuagguuugauuccuggguuaaccaauucuacacgcuugcccccaugggaaacggaacggggcguagacgugcuuuguaa

SEQ ID NO: 5768 - RNA, 1623 nt, Artificial Sequence; identical to SEQ ID NO: 5290
  VP1__Norovirus__BAU24864

SEQ ID NO: 5769 - RNA, 1623 nt, Artificial Sequence
  VP1__Norovirus__BAU24867
augaagauggcgucgagugacgccaacccaacugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaaucuuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacagucucuugccgaguucucaccagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5770 - RNA, 1623 nt, Artificial Sequence
  VP1__Norovirus__BAU24870
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcuuccaaguuacucaggcagaaauacuccuaaugugcaucuggcccccgcuguagcccccacuuuuccgggugagcaacuucucuucuucagauccaccaugcccggaugcagcggguaccccaacauggacuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5771 - RNA, 1623 nt, Artificial Sequence
  VP1__Norovirus__BAU24873
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaaugcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguggauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5772 - RNA, 1623 nt, Artificial Sequence
  VP1__Norovirus__BAU24876
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuucccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5773 - RNA, 1623 nt, Artificial Sequence
  VP1__Norovirus__BAU24879
augaagauggcgucgagugacgccaacccaucugauggguccgcagccaaccucgucccagaggucaacaaugagguuauggcucuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaucccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcuuccaaguuacucaggcagaaauacuccuaaugugcaucuggcccccgcuguagcccccacuuuuccgggugagcaacuucucuucuucagauccaccaugcccggaugcagcggguaccccaacauggacuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcgcagacgugcacuauaa

SEQ ID NO: 5774 - RNA, 1623 nt, Artificial Sequence
  VP1__Norovirus__BAU24882
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaaucuuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaccauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgauuuugcuccaaaacuggguagaguucaauuugaaacugacacagaccaugacuuugaaacuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggucaacaugauuugguuaucccccccaaugguuauuucagguuugauuccugggucaaccaguuuuacacgcuugcccccaugggaaauggaacggggcguagacgugcacuauaa

SEQ ID NO: 5775 - RNA, 1623 nt, Artificial Sequence
  VP1__Norovirus__BAU24885
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacagucgagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccagucggugucauccaagaugguggcaccacccaccgaaaugaaccccaacagugggugcucccaaguuacucaggcagagauacucauaaugugcaucuggcccccgcuguagcccccacuuuuccgggugagcaacuucucuucuucagauccaccaugcccggaugcagcggguaccccaacauggauuuggacugucugcucccucaggaaugggugcaguacuucuaccaagaggcagccccagcacaaucugauguggcccugcuaagauuugugaauccagacacagguaggguuuuguucgaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcaguauaa

SEQ ID NO: 5776 - RNA, 1623 nt, Artificial Sequence
  VP1__Norovirus__BAU24888
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucaccauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuucguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagagaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaccuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5777 - RNA, 1623 nt, Artificial Sequence
  VP1__Norovirus__BAU24891
augaagauggcgucgaaugacgccaacccaucugauggguccgcagccaaccucgucccagaggucaauaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauucucgcggggaacgcguucaccgccggaaaaauuauauuugcagcagucccaccaaauuuuccaacugaaggcuugagucccagucaggucaccauguuuccccauauaauaguggauguuaggcaauuggaaccuguguugauccccuuaccugauguuaggaauaauuuuuaccacuauaaucagucaaaugauucuacuauuaaauugauagcaaugcuguauacaccacuuagggcuaauaaugcuggggaagaugucuucacagucucuugucgaguucucacgaggccauccccugauuuugauuucauauuuuuggugccaccuacaguugagucaagaacuaagccauuuacugucccaauccuaacuguugaagaaaugaccaacucaagguuccccauuccuuuggagaaguuguucacgggucccagcagugccuuuguuguucaaccacaaaauggcagaugcacaacugauggcgugcucuuaggcaccacccagcugucuccugucaacaucugcaccuucagaggggaugucacccacauugcagguucucguaauuacacaaugaauuuggcuucuuuaaauuggaacaacuaugacccaacagaagaaauuccagccccucuagggacuccagauuucgugggaaagauccaagguaugcucacucaaaccacaaagggagauggcucgacccguggccauaaagcuacaguuuacacugggagugcccccuucacuccaaagcugggcaguguccaauucgcaacugacacagaaaaugauuuugaaacccaccaaaacacaaaauucaccccagucggugucauccaggaugguggcaccacccaccgaaaugaaccucaacaaugggugcucccaaguuauucagguagaaaugucccuaauguacaccuagccccugcuguagcccccacuuuuccgggugaacaacuccuuuucuuuagguccacuaugcccggaugcagcggguaucccaacauggauuuggacugccugcuaccccaggagugggugcagcacuucuaccaagaggcagcuccagcacaaucugauguggcucuauugagauuugugaauccagacacggguaggguccuguuugagugcaaacuucauaaaucaggcuaugucacaguggcccacaccggccagcaugauuuggucaucccccccaaugguuauuuuagguuugauuccuggguuaaccaauucuacacgcuugcccccaugggaaacggaacggggcguagacgugcuuuguaa

SEQ ID NO: 5778 - RNA, 1623 nt, Artificial Sequence
  VP1__Norovirus__BAU24894
augaagauggcgucgagugacgccaacccaucugauggguccgcagccaaccucgucccagaggucaacaaugaggucauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacuaucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuguaa

SEQ ID NO: 5779 - RNA, 1623 nt, Artificial Sequence
  VP1__Norovirus__BAU24897
augaagauggcgucgagugacgccaacccaucugauggguccgcagccaaccucgucccagaggucaacaaugaggucauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaccccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacuaucuccugucaacaucugcaccuucagaggagaugucacccauaucacagguagucguaacuacacaaugaauuuggcuucucaaaauuggagcaauuaugacccaacagaagaaaucccagccccucuaggaaccccagauuuuguggggaagauucaaggcgugcucacccaaaccacaaggacagauggcucaacacgcggccacaaagccacaguguacacugggagcgccgacuuuguuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuguaa

SEQ ID NO: 5780 - RNA, 1623 nt, Artificial Sequence
  VP1__Norovirus__BAU24900
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaaucuuauggagcgcgcccuugggcccugaucuaaaucccuaccuaucccauuuggcuagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaaccaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacggauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguugcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5781 - RNA, 1623 nt, Artificial Sequence; identical to SEQ ID NO: 5290
  VP1__Norovirus__BAU24903

SEQ ID NO: 5782 - RNA, 1623 nt, Artificial Sequence
  VP1__Norovirus__BAU24906
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccacauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggacccagcagugccuuuguuguccaaccacaaaacgguaggugcacgacugauggcgugcuccuaggcaccacccaacugucuccugucaacaucugcaccuucagaggagaugucauccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuauuccccccaaugguuauuuuagguuugauuccugggucaaccaguuuuacacgcuugcccccaugggaaauggaacggggcguagacgugcacuauaa

SEQ ID NO: 5783 - RNA, 1623 nt, Artificial Sequence
  VP1__Norovirus__BAU24909
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaaucuuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuauaaucaaucaaaugaccccaccauuaaguugauagcaauguuguauacaccacuuagggcuaauaaugcuggggaugaugucuucacagucucuugccgaguucucacgagaccaucccccgauuuugauuucauauuucuagugccacccacaguugagucaagaaccaaaccauucucugucccaguuuuaacuguugaggagaugaccaauucaagauuccccauuccuuuggaaaaguuguucacgggucccagcagugccuuuguuguucaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5784 - RNA, 1623 nt, Artificial Sequence
  VP1__Norovirus__BAU24912
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccagguuacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccccuaggaacuccagauuuuguggggaagauucaaggcgugcucacccaaaccacaaggacagauggcucaacacgcggccacaaagccacaguguacacugggagcgccgacuuugccccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagauacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5785 - RNA, 1623 nt, Artificial Sequence
  VP1__Norovirus__BAU24915
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaguaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccaacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5786 - RNA, 1623 nt, Artificial Sequence
  VP1__Norovirus__BAU24918
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaacacuccuaaugugcaucuggcccccgcuguagcccccacuuuuccgggugagcaacuucucuucuucagauccaccaugcccggaugcagcggguaccccaacauggauuuggacugucugcucccucaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5787 - RNA, 1623 nt, Artificial Sequence; identical to SEQ ID NO: 5290
  VP1__Norovirus__BAU24921

SEQ ID NO: 5788 - RNA, 1623 nt, Artificial Sequence
  VP1__Norovirus__BAU24924
augaagauggcgucgagugacgccaacccaucugauggguccgcagccaaccucgucccagaggucaacaaugagguuauggcucuggagcccguugucggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccacauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugacuucauauuucuagugccacccacaguugagucaagaacuaaaccauucucugucccaguuuuaacuguugaggagaugaccaauucaagauuccccauuccuuuggaaaaguuguucacgggacccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5789 - RNA, 1623 nt, Artificial Sequence
  VP1__Norovirus__BAU24927
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuuaggcccugaucuaaaucccuaccuaucccauuuagcuagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggaauuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5790 - RNA, 1623 nt, Artificial Sequence
  VP1__Norovirus__BAU24930
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugagauacuauggagcgcgcccuuaggcccugaucuaaaucccuaccuuucccauuuggccagaauguacaaugguuaugcaggugguuuugaagugcagguaauucucgcggggaacgcguucaccgccgggaaggucauauuugcagcagucccaccaaauuuuccaacugaaggcuuaagccccagccaggucacuauguucccccauauaauaguagauguuagacaacuagaaccugugcugauucccuuacccgaugucaggaauaauuucuaucauuacaaucaaucaaaugacuccacuauuaaguugauagcaauguuguauacaccacuuagggcuaauaaugcuggggaugaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccacaaaacggcaggugcacgacugauggcgugcuccuaggcaccacccaacugucuccugucaacaucugcaccuucagaggggaugucacccacaucacagguagucguaacuacacgaugaauuuggcuucucaaaauuggaacaauuaugacccaacagaagaaaucccagccccucuagggacuccagauuuuguggggaaaauucaaggcaugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccagucgguguuauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguucuacacgcuugcccccaugggaaauggaacggggcguagacguguaguauaa

SEQ ID NO: 5791 - RNA, 1623 nt, Artificial Sequence
  VP1__Norovirus__BAU24933
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcaggugauccucgcggggaacgcguucaccgccgggaaaaucauauuugcagcagucccaccaaauuucccaacugaagguuugagccccagccaagucaccauguucccccacauaauaguagauguuaggcaauuggaaccuguguugauccccuuacccgauguuaggaauaauuucuaccauuauaaucaaucaaaugacuccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaacucaagguuccccauuccuuuggaaaaauuguucacgggccccaguagugccuuuguuguucaaccacaaaacggcaggugcacuacugauggcgugcuccuagguaccacccaacugucuccugucaacaucugcaccuucagaggggaugucacccauauuucaggcagucguaacuacacaaugaauuuggccucccaaaauuggaacaguuacgauccaacagaagaaaucccagccccuuuaggaacuccagauuucguggggaagauucaaggugugcuuacccaaaccacaaggacaaauggcucgacccgcggccacaaagcuacaguguacacugggagcgccgacuuuucuccaaaacuggguagaguccaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauucauaaugugcaccuggcccccgcuguagccccuacuuucccgggcgagcagcuucucuucuucagaucuacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 5792 - RNA, 1623 nt, Artificial Sequence
  VP1__Norovirus__BAU24936
augaagauggcgucgaaugacgccaacccaucugauggguccgcagccaaccucgucccggaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauuuuugcagcagucccaccaaauuuuccaacugaaggcuugagucccagccaggucacuauguucccccauauaauaguggauguuaggcaauuggaaccuguguugauccccuuaccugauguuaggaauaacuucuaucauuauaaucagucaaaugauucuaccauuaaauugauagcaauguuguauacaccacuuagggcuaauaaugcuggggaagaugucuuuacagucucuugucgaguucucacgaggccauccccugauuuugauuuuauauucuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacuguccccugucaacaucugcaccuucagaggggaugucacccacauugcagguucucguaauuauacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucgguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccaggugaacaacuucuuuucuuuagguccacuaugcccggaugcagcggguaucccaacauggauuuggauugccugcucccccaggagugggugcagcacuuuuaccaagaggcagcuccagcacaaucugauguggcucuauugagauuuguaaauccagacacggguaggguucuguuugagugcaaacuucacaaaccaggcuaugucacaguggcucacaccggccagcaugauuuggucaucccccccaauggcuauuucagguuugauuccuggguuaaucaguucuacacacuugcccccaugggaaauggaacggggcguagacgugcuuuauaa

SEQ ID NO: 5793 - RNA, 1623 nt, Artificial Sequence
  VP1__Norovirus__BAU24942
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccaggauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccagucuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagacgucacccauaucacagguagucguaacuacacaaugaauuuggcuucucaaaauuggagcaauuaugacccaacagaagaaaccccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5794 - RNA, 1623 nt, Artificial Sequence
  VP1__Norovirus__BAU24945
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccaggauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccagucuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagacgucacccauaucacagguagucguaacuacacaaugaauuuggcuucucaaaauuggagcaauuaugacccaacagaagaaaccccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5795 - RNA, 1623 nt, Artificial Sequence
  VP1__Norovirus__BAU24948
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguaguaccgcccaccgaaaugaaccccaacagugggugcuuccaaguuacucaggcagaaauacuccuaaugugcaucuggcccccgcuguagcccccacuuuuccgggugagcaacuucucuucuucagauccaccaugcccggaugcagcggguaccccaacauggacuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5796 - RNA, 1623 nt, Artificial Sequence
  VP1__Norovirus__BAU24950
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgccccuaggcccugacuugaaucccuaccuuucccauuuggccagaauguacaaugguuaugcaggugguuuugaagugcagguaauccucgcggggaacgcguucaccgccgggaaaaucauauuugcagcagucccaccaaauuucccgacugaagguuugagccccagccaggucacuauguucccccacauaauaguggauguuaggcaauuggaaccuguguugauucccuuacccgauguuaggaauaauuucuaccauuauaaucaaucaaaugacuccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucuccgucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggaugucacccauauuccaggcagucguaacuacacaaugaauuuggccucccaaaauuggaacaguuacgauccaacagaagaaaucccagccccuuuaggaacuccagauuucguggggaagauucaaggugugcucacccaaaccacaaggacaaauggcucgacccgcggccacaaagcuacaguguauacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucacaaugugcaccuggcccccgcuguagcccccacuuucccgggcgagcagcuccucuucuucagaucuacuaugcccggaugcagcggguaccccaacauggacuuggacugucugcucccccaggaaugggugcaguauuucuaccaggaggcagccccagcacaaucugauguggcccugcuaagauuugugaauccggacacagguaggguuuuguuugaguguaagcuucauaaaucaggcuauguuacaguggcucauacuggccaacaugauuugguuaucccccccaaugguuacuuuagauuugauuccugggucaaccaguucuacacacuugcccccaugggaaaugggacggggcguagacgugcauuguaa

SEQ ID NO: 5797 - RNA, 1623 nt, Artificial Sequence
  VP1__Norovirus__BAU24952
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgccuuugggcccugaucuaaaucccuaccuaucccauuuggccagaauguacaaugguuaugcaggugguuuugaagugcagguaauucucgcggggaaugcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgauuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguggcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5798 - RNA, 1623 nt, Artificial Sequence
  VP1__Norovirus__BAU24954
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguguccccuagaaacgcuccaggugaaaucuuauggagcgcgcccuuaggcccugaucuaaaucccuaccuaucccauuuggccagaauguauaaugguuaugcagguggcuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaagcugauagcaauguuguauacaccacuuagggcuaauaaugcuggggacgaugucuucacaguuucuugccgaguucucacgagaccaucccccgauuuugauuucauauuccuagugccacccacaguugagucuagaacuaaaccauucucugucccaguuuuaacuguugaggagaugaccaauucaagguuccccauuccuuuggaaaaguuguucacgggucccagcagugccuuuguuguucaaccacaaaacgguaggugcacgacugauggcgugcuccuaggcaccacccaauugucuccugucaacaucugcaccuucagaggggaugucacccacaucacagguagucguaacuacacaaugaauuuggcuucucaaaauuggaacaauuaugacccaacagaagaaaucccagccccucuaggggcuccagauuuuguggggaagauucaaggcaugcucacccaaaccacaagggcagauggcucaacacgcggccacaaagcuacaguguacacugggagcgccgacuuugcuccaaaacugggcagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaauguucaucuggcccccgcuguagcccccacuuuuccgggugagcaacuucucuucuuuagauccaccaugcccggauguagcggguaccccaacauggauuuggacugucugcuuccccaggaaugggugcaguacuucuaccaagaggcagccccagcacaaucugauguggcucugcugagauuugugaauccggacacagguaggguuuuguuugaguguaagcuucauaaaucaggcuauguuacaguggcucacacuggccaacaugauuugguuaucccccccaaugguuauuuuagguuugauuccugggucaaccaguucuacacgcuugcccccaugggaaauggagcggggcguagacguguaguauaa

SEQ ID NO: 5799 - RNA, 1623 nt, Artificial Sequence
  VP1__Norovirus__BAU24958
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuucccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5800 - RNA, 1623 nt, Artificial Sequence
  VP1__Norovirus__BAU24960
augaagauggcgucgaaugacgccaacccaucugaugggcccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucaucuggccagaauguauaaugguuaugcaggugguuuugaagugcaggugauucucgcggggaacgcguucaccgccggaaaaauuauauuugcagcagucccaccaaauuuuccaacugaaggcuugagucccagucaggucaccauguucccccauauaauaguggauguuaggcaauuggaaccuguguugauccccuuaccugauguuaggaauaauuucuaccacuauaaucagucaaaugauucuaccauuaaauugauagcaaugcuguauacaccacuuagggcuaauaaugcuggggaagaugucuucacagucucuugucgaguucucacgaggccauccccugauuuugauuucauauuuuuggugccaccuacaguugagucaagaacuaagccauuuacugucccaauccuaacuguugaagaaaugaccaacucaagguuccccauuccuuuggagaaguuguucacgggucccagcagugccuuuguuguucaaccacaaaauggcagaugcacaacugauggcgugcucuuaggcaccacccagcugucuccugucaacaucugcaccuucagaggggaugucacccacauugcagguucucguaauuauacaaugaauuuggcuucucuaaauuggaacaacuaugacccaacagaagaaauuccagccccucuaggaacuccagauuucgugggaaagauccaagguaugcucacucaaaccacaaagggagauggcucgacccguggccauaaagcuacaguuuacacugggagugcccccuucacuccaaagcugggcaguguccaauucgaaacugacacagaaaaugauuuugaaacccaccaaaacacaaaauucaccccagucggugucauccaggaugguggcaccacccaccgaaaugaaccucaacaaugggugcucccgaguuauucagguagaaaugucccuaauguacaccuagccccugcuguagcccccacuuuuccgggugaacaacuccuuuucuuuagguccauuaugcccggaugcagcggguaucccaacauggacuuggacugccugcuaccccaggagugggugcagcacuucuaccaagaggcagcuccagcacaaucugauguggcucuauugagauuugugaauccagacacggguaggguccuguuugagugcaaacuucauaagucaggcuaugucacaguggcccauaccggccagcaugauuuggucaucccccccaaugguuauuuuagguuugauuccuggguuaaccaauucuacacgcuugcccccaugggaaacggaacggggcguagacgugcuuuguaa

SEQ ID NO: 5801 - RNA, 1623 nt, Artificial Sequence
  VP1__Norovirus__BAU24962
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccuguuaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauaccccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5802 - RNA, 1623 nt, Artificial Sequence
  VP1__Norovirus__BAU24964
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucaucuggccagaauguauaaugguuaugcaggugguuuugaagugcaggugauucucgcggggaacgcguucaccgccgggaaaauuauauuugcagcagucccaccaaauuuuccaacugaaggcuugagucccagucaggucaccauguucccccauauaauaguggauguuaggcaauuggaaccuguguugauccccuuaccugauguuaggaauaauuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuucauauuuuuggugccaccuacaguugagucaagaacuaagccauuuacugucccaauccuaacuguugaagaaaugaccaacucaagguuccccauuccuuuggagaaguuguucacgggucccagcagugccuuuguuguucaaccacaaaauggcagaugcacaacugauggcgugcucuuaggcaccacccagcugucuccugucaacaucugcaccuucagaggggaugucacccacauugcagguucucguaauuauacaaugaauuuggcuucucuaaauuggaacaacuaugacccaacagaagaaauuccagccccucuaggaacuccagauuucgugggaaagauccaagguaugcucacucaaaccacaaagggagauggcucgacccguggccauaaagcuacaguuuacacugggagugcccccuucacuccaaagcugggcaguguccaauucgaaacugacacagaaaaugauuuugaaacccaccaaaacacaaaauucaccccagucggugucauccaggaugguggcaccacccaccgaaaugaaccucaacaaugggugcucccgaguuauucagguagaaaugucccuaauguacaccuagccccugcuguagcccccacuuuuccgggugaacaacuccuuuucuuuagguccauuaugcccggaugcagcggguaucccaacauggacuuggacugccugcuaccccaggagugggugcagcacuucuaccaagaggcagcuccagcacaaucugauguggcucuauugagauuugugaauccagacacggguaggguccuguuugagugcaaacuucauaagucaggcuaugucacaguggcccauaccggccagcaugauuuggucaucccccccaaugguuauuuuagguuugauuccuggguuaaccaauucuauacgcuugcccccaugggaaacggaacggggcguagacgugcuuuguaa

SEQ ID NO: 5803 - RNA, 1623 nt, Artificial Sequence
  VP1__Norovirus__BAU24966
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucaucuggccagaauguauaaugguuaugcaggugguuuugaagugcaggugauucucgcggggaacgcguucaccgccggaaaaauuauauuugcagcagucccaccaaauuuuccaacugaaggcuugagucccagucaggucaccauguucccccauauaauaguggauguuaggcaauuggaaccuguguugauccccuuaccugauguuaggaauaauuucuaccacuauaaucagucaaaugauucuaccauuaaauugauagcaaugcuguauacaccacuuagggcuaauaaugcuggggaagaugucuucacagucucuugucgaguucucacgaggccauccccugauuuugauuucauauuuuuggugccaccuacaguugagucaagaacuaagccauuuacugucccaauccuaacuguugaagaaaugaccaacucaagguuccccauuccuuuggagaaguuguucacgggucccagcagugccuuuguuguucaaccacaaaauggcagaugcacaacugauggcgugcuuuuaggcaccacccagcugucuccugucaacaucugcaccuucagaggggaugucacccacauugcagguucucguaauuauacaaugaauuuggcuucucuaaauuggaacaacuaugacccaacagaagaaauuccagccccucuaggaacuccagauuucgugggaaagauccaagguaugcucacucaaaccacaaagggagauggcucgacccguggccauaaagcuacaguuuacacugggagugcccccuucacuccaaagcugggcaguguccaauucgaaacugacacagaaaaugauuuugaaacccaccaaaacacaaaauucaccccagucggugucauccaggaugguggcaccacccaccgaaaugaaccucaacaaugggugcucccgaguuauucagguagaaaugucccuaauguacaccuagccccugcuguagcccccacuuuuccgggugaacaacuccuuuucuuuagguccauuaugcccggaugcagcggguaucccaacauggacuuggacugccugcuaccccaggagugggugcagcacuucuaccaagaggcagcuccagcacaaucugauguggcucuauugagauuugugaauccagacacggguaggguccuguuugagugcaaacuucauaagucaggcuaugucacaguggcccauaccggccagcaugauuuggucaucccccccaaugguuauuuuagguuugauuccuggguuaaccaauucuauacgcuugcccccaugggaaacggaacggggcguagacgugcuuuguaa

SEQ ID NO: 5804 - RNA, 1623 nt, Artificial Sequence
  VP1__Norovirus__BAU24968
augaagauggcgucgagugacgccaacccaucugauggguccacagccaaccuugucccagaggucaacaaugagguuauggcuuuggagcccguaauuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucugaaucccuaccuuucucauuuguccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauaugauaguagaugucaggcaauuggaaccuguguugauucccuuacccgauguuagaaauaauuucuaucauuauaaucaaucaaaugauuccaccaucaaauugauagcaauguuguacacaccacuuagggcuaauaaugccggggaugaugucuucacaguuucuugucgaguucucacgagaccaucccccgauuuugauuucauauuuuuggugccacccacaguugaaucaagaacuaaaccuuucucugucccaguuuuaacuguugaggagaugaccaauucaagguuccccauuccuuuggaaaaguuguucacgggucccaguagugccuuuguuguucaaccacaaaacggcaggugcacaacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccguggccacaaagcuacaguguacacugggagcgccgacuucucuccaaaacuggguagaguucaauuugccacugacacagacaaugauuuugaaacuaaccaaaacacaaaguucaccccagucgguguuauccaggaugguaguaccaccccccgaaaugagccccaacaaugggugcucccaaguuauucaggcagaaacauucauaaugugcaccuggcccccgcuguagcccccacuuucccgggcgagcagcuccuuuucuucagaucuacuaugcccggaugcagcggguaccccaacauggacuuggacugucugcucccccaggaaugggugcaguauuucuaccaggaggcagccccagcacaaucugauguggcucuguuaagauuugugaauccggacacagguaggguuuuguuugaguguaagcuccauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 5805 - RNA, 1623 nt, Artificial Sequence
  VP1__Norovirus__BAU24972
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaaucuuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagauaucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcuuccaaguuacucaggcagaaauacuccuaaugugcaucuggcccccgcuguagcccccacuuuuccgggugagcaacuucucuucuucagauccaccaugcccggaugcagcggguaccccaacauggacuuggauugucugcucccccaggaaugggugcagcacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaacggaacggggcguagacgugcacuauaa

SEQ ID NO: 5806 - RNA, 1623 nt, Artificial Sequence
  VP1__Norovirus__BAU24974
augaagauggcgucgagugacgccaacccaucugauggguccgcagccaaccucgucccagaggucaacaaugaggucauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagugccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaacuacuccuaaugugcaucuggcccccgcuguagcccccacuuuuccgggugagcaacuucucuucuucagauccaccaugcccgggugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuguaa

SEQ ID NO: 5807 - RNA, 1623 nt, Artificial Sequence
  VP1__Norovirus__BAU24976
augaagauggcgucgagugacgccaacccaucugauggguccgcagccaaccucgucccagaggucaacaaugagguuauggcucuggagcccguuguuggugccgccauugcggcaccuguagcgggccagcaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaagcuuauagcaauguuguauacaccacuuagggcuaauaaugcuggggaugaugucuucacaguuucuugccgaguucucacgagaccaucccccgauuuugauuucauauuucuagugccacccacaguugagucaagaaccaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacguggccacaaagcuacaguguacacugggagcgccgauuuugcuccaaaacuggguagaguucaauuugaaacugacacagaccaugauuuugaagcuaaccaaaacacaaaguucaccccaguuggcgucauccaagaugguggcaccacccaccgaaaugaaccccaacagugggugcucccaaguuacucaggcagaaauacuccuaaugugcaucuggccccugcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5808 - RNA, 1623 nt, Artificial Sequence; identical to SEQ ID NO: 5770
  VP1__Norovirus__BAU24978

SEQ ID NO: 5809 - RNA, 1623 nt, Artificial Sequence
  VP1__Norovirus__BAU24980
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcacuacccaccgaaaugaaccccaacagugggugcuuccaaguuacucaggcagaaauacuccuaaugugcaucuggcccccgcuguagcccccacuuuuccgggugagcaacuucucuucuucagauccaccaugcccggaugcagcggguaccccaacauggacuuggacugucugcucccccaggaaugggugcaguacuucuaccaagaggcagccccagcacaaucugauguggcucugcuaagauuugugaacccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5810 - RNA, 1623 nt, Artificial Sequence
  VP1__Norovirus__BAU24982
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccaacuuugcuccaaaacuggguagaauucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuuuuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5811 - RNA, 1623 nt, Artificial Sequence
  VP1__Norovirus__BAU24984
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacaacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcuuccaaguuacucaggcagaaauacuccuaaugugcaucuggcccccgcuguagcccccacuuuuccgggugagcaacuucucuucuucagauccaccaugcccggaugcagcggguaccccaacauggacuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5812 - RNA, 1623 nt, Artificial Sequence; identical to SEQ ID NO: 5290
  VP1__Norovirus__BAU24986

SEQ ID NO: 5813 - RNA, 1623 nt, Artificial Sequence
  VP1__Norovirus__BAU24988
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuugggcccugaucugaaccccuaccuaucucauuuggccagaauguauaaugguuaugcaggugguuuugaagugcaggugauucucgcggggaacgcguucaccgccgggaaaaucauauuugcagcagucccaccaaauuuuccaacugaaggcuugagucccagucaggucaccauguucccccauauaauaguggauguuaggcaauuggaaccuguguugauccccuuaccugauguuaggaauaauuucuaucauuauaaucagucaaaugauucuaccauuaaauugauagcaaugcuguauacaccacuuagggcuaauaaugcuggggaagaugucuuuacagucucuugucgaguucucacgaggccauccccugauuuugauuucauauuuuuggugccaccuacaguugagucaagaacuaagccauuuacugucccaaucuuaacuguugaagaaaugaccaacucaagguuccccauuccuuuggagaaguuguucacgggucccagcagugccuuuguuguucaaccacaaaauggcagaugcacaacugauggcgugcucuuaggcacuacccagcugucuccugucaacaucugcaccuucagaggggaugucacccacauugcagguucucguaauuacacaaugaauuuggcuucucuaaauuggaacaauuaugacccaacagaagaaauuccagccccucuaggaacuccagacuucgugggaaagauccaagguaugcucacucaaaccacaaagggagauggcucgacccguggccauaaagcuacaguuuacacugggagugcccccuucacuccaaagcugggcaguguccaauucgaaacugacacagaaaaugauuuugaaacccaccaaaacacaaaauucaccccaguuggugucauccaggaugguggcaccacccaccgaaaugaaccucaacagugggugcucccaaguuauucagguagaaaugucccuaauguacaccuagccccugcuguagcccccacuuuuccgggugaacaacuccuuuucuuuagguccacugugcccggaugcagcggguaucccaacauggacuuggacugccugcuaccccaggagugggugcagcacuucuaccaagaggcagcuccagcacaaucugauguggcucuauugagauucgugaauccagacacggguaggguccuguuugagugcaaacuucauaaaucagguuaugucacaguggcccacaccggccagcaugauuuggucaucccccccaaugguuauuuuagguuugauuccuggguuaaccaauucuacacgcuugcccccaugggaaacggaacggggcguagacgugcuuuguaa

SEQ ID NO: 5814 - RNA, 1623 nt, Artificial Sequence
  VP1__Norovirus__BAU24990
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuaggaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaacaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccaucccuuuggaaaaguuguucacgggucccagcagugccuuuguuguccaaccacaaaacggcaggugcacgacugauggcgugcuccuaggcaccacccagcugucuccugucaacaucugcaccuucagaggagaugucacccauaucacagguagucauaacuacacaaugaauuuggcuucucaaaauuggaacaauuaugacccaacagaagaaaucccagccccucuaggaacuccagauuuuguggggaagauucaaggcgugcucacccaaaccacgaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaauuuuacacgcuugcccccaugggaaauggaacggggcguagacgugcaguguaa

SEQ ID NO: 5815 - RNA, 1623 nt, Artificial Sequence
  VP1__Norovirus__BAU24992
augaagauggcgucgagugacgccaacccaucugauggguccgcagccaaccucgucccagaggucaacaaugaggucauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggccaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacuaucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagauauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguaggcgugcacuguaa

SEQ ID NO: 5816 - RNA, 1623 nt, Artificial Sequence
  VP1__Norovirus__BAU24994
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguucacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauuccuuuacccgauguuaggaauaauuucuaucauuacaaucaaucaaaugaccccaccaucaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcaguauaa

SEQ ID NO: 5817 - RNA, 1623 nt, Artificial Sequence
  VP1__Norovirus__BAU24996
augaagauggcgucgagugacgccaacccaucugauggguccgcagccaaccucgucccagaggucagcaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacucauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5818 - RNA, 1623 nt, Artificial Sequence
  VP1__Norovirus__BAU24998
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagacgucacccauaucacagguagucguaacuacacaaugaauuuggcuucucaaaauuggagcaauuaugacccaacagaagagaucccagccccucuaggaacuccagauuuuguggggaagauucaaggcgugcucacccaaaccacaaggacagauggcucaacacguggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5819 - RNA, 1623 nt, Artificial Sequence
  VP1__Norovirus__BAU25002
augaagauggcgucgagugacgccaacccaucugauggguccgcagccaaccucgucccagaggucaacaaugaggucauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugacuccaccauuaaguugauagcaauguuguauacaccacuuagggcuaauaaugcuggggaugaugucuucacaguuucuugccgaguucucacgagaccaucccccgauuuugauuucauauuucuagugccaccuacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacuaucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuguaa

SEQ ID NO: 5820 - RNA, 1623 nt, Artificial Sequence
  VP1__Norovirus__BAU25004
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuauaaucaaucaaaugaccccaccauuaaguugauagcaauguuguauacaccacuuagggcuaauaaugcuggggaugaugucuucacagucucuugccgaguucucacgagaccaucccccgauuuugauuucauauuucuagugccacccacaguugagucaagaaccaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 5821 - RNA, 1644 nt, Artificial Sequence
  VP1_protein__Norovirus__ADN84676
augaagauggcgucuagugacgcagcuccaucuacggauggauccgccggucucguaccagaggucaacaaugagaccauggcccuagaaccaguggugggugcuccccuugcugcccccguugcuggucaacauaacauuauagaccccuggauuaaaaugaauuuugugcaggcaccuaauggagaauuuacuguuuccccccguaaugccccaggugagauuuuauuagauuuagaacuuggcccugaucuuaaucccuaccuuucacauuuggcccguauguauaauggcuaugcaggugguauggagguacaaguugugcuggcugggaaugccuuuacugcugggaagaucauuuuugcugcuguuccaccaaauuuuccagcagagaaccuuagcgcggcacaagucaccaugugcccucaugugauaguugaugugagacaacuggaaccaguuaugcuccccaugccugauauucggaauaaacuauuucacuacaaucaaguugaugacccaaagcucagauuguuggccuaccuuuauacaccucuccgggcuaacaaugcuggggaugauguuuucacaguuucuugucggguucuuacuagaccaaccccagacuuugaguuuauguuuuugguuccucccacuguugaauccaaaaccaaaccuuuuucuuugcccaaccuuacucuugaugaacuuucuaauucuagguuucccgcgccuauaguucagcuuuacacaaacccucaugauaacuugguugugcagccucagaacggaagauguacuauagauggucuuuugcagggcaccacacaacuuguguccuguaaugucuguaguuuuaggggcaccaugggugagggacaaccagcaagccauagugaggaugagaucaugcccauggccaucaauguccagcgugagaucaugcuggagaaccuugauggcucgccuuaugacccaacugaugacaucccggcagucuuggguucuccugacuuccagggggucauguuuggcauucucagucaaaggaacacugacgggcaaacuagggcacaugaggccaagguggacacuagggcggcucguuuugccccuaaacuuggcuuuguuguggccacuguggagagcacggauuuccacgccaaccaacccagcagguuuacucccguugggcuggguggggaugccaaccgggacuuuaaccaguggcaguuaccagcuuacggcggcgcguugacaaacaacaccaaccucgccccgcccgugaugccuguuuacccaggggagcagcuucucuuuuuccgcucccagcuuccgagcucugguggugugguugccggguggcuggauugccugcucccccaggaguggguucaacacuucuuccaggagucggcaaccucccaaagcaauguggcccugguuagguaugugaaccccacuacggguagagugcucuuugaagcaaaguuacacaaacaaggcuuucucaccguggccgccucaggcucuuauccccugguuguuccugcugaugguuacuuuagauuugaaucuugggugaaugaauuuuacaccuuggcccccaugggaaauggcagugggcgcagacgugcucguuaa

SEQ ID NO: 5822 - RNA, 1623 nt, Artificial Sequence
  VP1_protein__Norovirus__BAK68870
augaagauggcgucgaaugacgccagcccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaagugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccuguuaacaucugcaccuucagaggggaugucacccacauugcaggcucucguaauuacacaaugaacuuggcuucccuaaauuggaacaauuaugacccaacagaagaaauuccagccccucuagggacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5823 - RNA, 1620 nt, Artificial Sequence
  capsid__Norovirus__AAC54893
augaagauggcgucgagugacgccaacccaucugauggguccgcagccaaccucgucccagaggucaacaaugagguuauggcucuggagcccguuguuggugccgcuauugcggcaccuguagcgggccaacaaaauauaauugaccccuggauuagaaauaauuuuguacaagccccugguggagaguuuacaguguccccuagaaacgcuccaggugagauacuauggagcgcgcccuugggcccugauuugaaucccuaucuuucucacuuguccagaauguauaaugguuaugcaggugguuuugaagugcaagugauccuugcggggaacgcguucaccgccgggaaaguuauauuugcagcaguuccaccaaacuuuccaacugaaggcuuaagccccagccagguuacuauguucccccauauaauuguagauguuagacaacuggaaccuguguugauuccccuaccugaugucaggaauaauuucuaucauuacaaucaaucacaugauucuacccuuaaauugauagcaaugcuguacacaccacuuagggcuaauaaugccggggaugaugucuuuacagucucuugucgaguucucacgagaccaucccccgauuuugauuuuauauucuuggugccacccacaguugaaucaagaacuaaaccauucaccgucccaauuuuaaccguugaggaaauguccaauucaagauuccccauuccuuuggaaaagcuguauacgggucccagcagugcuuuuguuguacaaccacaaaauggcagaugcacgacugacggcgugcucuuaggcacuacccagcugucagcugucaacaucugcaacuuuaggggggaugucacccauauugugggcagccaugauuauacaaugaacuuggcuucccaaaauuggagcaauuaugacccaacagaagaaaucccagccccccugggaacaccagauuuuguggggaagauccaaggucugcucacccaaaccacaagagcagauggcucgacccgugcccacaaagcuacagugagcacugggaguguccacuucacuccaaagcuggguaguguucaauucaccacugacacaaacaaugauuuccaaacuggccaaaacacgaaauucaccccaguuggugucauccaagacggugaccaccaccagaaugagccccaacaauggguacucccgaauuauucagguagaacuggucauaaugugcaccuggccccugccguugcccccacuuuuccgggugagcaacuccuuuucuuuagauccacuaugcccggguguagcggguaucccaacaugaacuuggacugccuacucccccaggaaugggugcugcacuucuaccaggaagcagcuccagcacaaucugauguggcucugcugagauuugugaauccagacacagguaggguucuguuugagugcaagcuccauaagucaggcuacaucacaguggcccacaccggcccguuugacuugguuauccccccuaaugguuauuuuagauuugauucuugggucaaccaguucuacacacuugcccccaugggaaaugggacggggcgcaggcgugcauuauaa

SEQ ID NO: 5824 - RNA, 1647 nt, Artificial Sequence
  capsid__Norovirus__AAW30195
augaagauggcgucgaaugacgccacuccaucuaaugauggugccgccggccucgucccagagaucaacaaugaggcaauggcgcuagauccaguggcgggugcagcgauagcagcaccccucacuggucagcaaaauauaauugaucccuggauuaugaauaauuuugugcaagcaccugguggugagcuuacaguauccccuaggaauuccccuggugaagugcuucuuaauuuggaauugggcccagaaauaaaccccuauuuggcccaucuugcuagaauguauaaugguuaugcagguggauuugaagugcagguaguccuagcuggaaaugcguuuacagcaggaaagauaaucuuugcagcuauacccccuaauuuuccaauugauaaucuaagugcagcacagaucacaaugugcccacaugugauuguggaugucagacaguuggaaccggucaaccucccgaugccugacguucgcaacaacuucuuucauuacaaucaagggucugauacgagauugcgcuuaauugcaaugcuguauacaccucuuagggcaaauaguucuggggaugauguuuuuacugugucuuguagggugcugacuaggccuagcccugauuuuucauuuaauuuccuugugccaccuacuguggagucaaagacaaagcccuucacccucccuauccugacuaucucugaaauguccaauucuagguuuccagugccgauugauucucugcacaccagcccaacugagaauauuguuguccagugccaaaaugggcgcgucacucuugauggugaguugaugggcaccacccaacuuuuaccuagucaaaucugugcuuucaggggcaugcucaccaggucaacaagcagggccagugaucaggccgacacagcagccccuagguuguuuaauuaucauuggcauauacaguuggauaaucuaaaugggacuccuuaugauccugcagaggacauaccaggcccccuagggacaccagauuuccggggcaaagucuuugguguggccagccagagaaaucccgacagcacaacuagagcgcaugaagcaaagguggacacaacagcuggucguuucaccccaaaauuaggcucauuagagauauccaccgaaucuggugaccuugaucaaaaccaaccaacaaaauucaccccaguuggcauugggguugaccaugaggaagacuuucaacaaugguccuuacccgacuauucuggucaguucacccacaacaugaacuuagccccagcuguugcucccaacuucccuggugagcagcuccuuuucuuccgcucacaguuaccauccucuggugggcgauccaacgggauucuagacugccuggucccccaggaauggguucagcacuucuaccaagaaucggcccccgcccaaacucaaguggcccugguuagguaugucaacccugacacugguagaguauuauuugaggccaagcugcacaaauuagguuucaugacuauagcuaagaauggugacuccccaauaacugucccuccaaauggauacuuuggguuugaaucuugggugaacccauuuuauacacuugcccccaugggaacugggaaugggcguagaaggauucaauaa

SEQ ID NO: 5825 - RNA, 1647 nt, Artificial Sequence
  capsid__Norovirus__ABD36491
augaagauggcgucgaaugacgcugcuccaucuaacgauggugccgccggccucgucccagagaucaacaaugaggcaauggcgcuagagccaguggcaggugcagcaauagcagcaccucucacuggccagcaaaauauaauugaucccuggauuaugaauaauuuugugcaagcaccugguggugaguuuacagugucgccuaggaacuccccuggugaaguacuucucaauuuagaauuagguccagaaauaaacccuuauuuggcccaccuugcuaggauguacaaugguuaugcagguggguuugaggugcagguaguccuggcuggaaaugcguuuacagcaggaaaggugaucuuugcagcuauacccccuaauuuuccaauugauaaucugagcgcagcacagauuacaaugugcccgcaugugauuguggaugucagacaguuggaaccaaucaaccuuccgaugccugauguccguaauaacuucuuucauuauaaucaagggucugauucuagguugcgcuuaauugcaaugcuguauacaccucuuagggcaaauaauucaggggaugauguuuucacugugucuuguaggguguuaacuaggccuagcccugauuucucauuuaauuuucucgucccgccuacuguagaaucaaagacaaagcccuucacccuccccaucuugacuauuucugaaaugucuaauucuagguuuccaguaccaauugacucucugcacaccagcccgacugagaacauuguuguccagugccaaaaugggcgagucacccuugacggugaguugaugggcaccacucaacucuugccgagucaaauaugugccuucaggggcacgcucaccagaucaacaagcagggccagugaccaagcugacacggcaaccccuagguuguucaacuacuauuggcacauacaauuggauaaucuaaauggaaccccauaugacccugcagaggacauaccagcccccuugggaacaccagacuuccggggcaaggucuucggcguagcuagccagagaaacccugauaguacaacaagggcacaugaagcaaaaguggacacaacaucuggucgcuucgccccgaaauuggguucccuagaaauauccacugaauccagugauuuugacucaaaccaaccaacaagguucaccccaguuggcauugggguugacaaugaggcagauuuucaacaauggucccuaccugacuacuccggucaguucacucacaacaugaacuuagccccagcugucgcccccaauuucccuggugagcagcuucucuucuuccguucacagcugccaucuucuggugggcggucuaaugggauucuggacugccuggucccccaggaauggguucaacauuucuaccaggaaucagccccugcccaaacacagguagcccugguuagguauguuaacccugacacuggcagagugcuauuugaggccaaguuacacaaacugggcuucaugacuauagcuaagaauggugauucuccaauaacugucccuccaaauggguacuucagauuugaaucuugggugaaccccuucuacacacuugcccccaugggaacuggaaaugggcguagaaggauucaauaa

SEQ ID NO: 5826 - RNA, 1629 nt, Artificial Sequence
  capsid__Norovirus__ABD36494
augaagauggcgucgaaugacgccgcuccaucuaaugauggugcagcuagucucguaccagagggcaucaaugagacuaugccauuggaacccguugcuggcgcaucuauugcugccccaguagcgggacaaacuaauauaauugaccccuggauaagaacaaauuuugugcaagcccccaauggagaauucacagugucgccaagaaauuccccuggagagauuuuguuaaauuuagaauuaggaccagaucuaaauccuuauuuagcccaucuaucaagaauguauaaugguuaugcuggagguguugaggugcaagugcuccuugcugggaaugcguucacagcagguaagauacuguuugcagcaauccccccuaacuuuccuguagauaugauuaguccagcccagaucacuaugcuuccccacuugauuguagauguuaggaccuuggaaccuaucaugauaccuuugccugauguuagaaauguguucuaucacuuuaauaaccaaccccaaccuagaaugaggcuaguggcuaugcuuuacaccccauugaggucuaaugguucaggagaugauguuuucacugugucuugcagaguacuaacuaggccaacuccugauuuugaguuuauuuauuugguacccccuucuguggagucuaaaaccaaaccauucacauuaccaauacugaccauuucugaauugaccaacucucgauucccuauuccaauugagcaauuguauacggccccaaaugagaacaauguuguccagugccaaaauggcaggugcaccuuggauggugagcuccaaggcacaacccagcugcugucaagugcgauaugcucuuauaggggcaggacuguggccaacaauggggauaauugggaccagaauuugcuccagcugaccuauccaaauggugcaagcuacgaccccaccgaugaaguaccagcaccauugggcacucaggauuuuagugggauguuauauggagugcugacccaggacaacacaaaugugagugcaggggaggccaaaaaugcuaagggaauauauauaucuaccaccaguggaaaauucaccccaaaaauugggucaauuggauugcauucaauaacugagcauguguaccccaaccaacagucgcgguucacuccuguuggaguugccgugaaugagaauacccccuuccaacaauggguucuaccacacuaugcagguagccuugcucucaacaccaauuuagcacccgcuguugccccaaccuucccuggugagcaauuguuauucuucaggucccguguuccauguguucaaggucagcaggggcaagauguguucauagauugucuccuaccccaagaguggguaaaucauuuuuaucaagaagcagcuccuucccaagcagacguugcccucaucagguaugucaacccugacacuggccgcacgcuguuugaagccaaauugcauagaucagguuucauuacuguaucacauacuggugcuuacccucuugugguccccccaaauggucauuuuagguuugauucuuggguuaaucaauuuuacucacucgccccuaugggaacuggcaaugggcgcaggagaauucaauaa

SEQ ID NO: 5827 - RNA, 1614 nt, Artificial Sequence
  capsid__Norovirus__ABD36497
augaagauggcgucgaaugacgcagcuccaucgagugauggcgcagccggccucgucccagagaucaaucacgagguuauggcaauugagccuguugcaggugcaucaaucgcugccccugugguaggacaacaaaauauuauugaucccuggauaagaaacaacuuuguacaagcaccugcuggagaauucacuguuuccccuaggaaugccccaggugaguucuugcuugauuuagaauuggguccugauuugaaccccuaucuggcacacuuggcaagaauguacaacggucaugcaggugguauggaagugcagauaguacuagcugggaaugcguucacagcggguaaaaucuuauuugccgucauaccgccuggguuuccguaugaaaauuuguccccagcacaacucacgaugugcccccacgucguaguugaugugaggcagcuugagccugucaugcugcccaugccagacaucaggaacacauucuuucauuauaaucaagauggugggccaagauugagauuaauugccauguuauauaccccucuuagagcuaauaauucaggugaugauguguucacuguuuccuguagaguucuaacaagaccugccccugauuuugaguuuacauuuuuagucccccccucuguugagucaaagaccaaggcauucaccaucccagugcuaaaaauuucugaaaugacaaauucaagauucccuguaccaguugaucaaauguacacuagcaggagugagggaaucgugguccaaccucagaaugguagggccacuauugacggggagcuacucggcaccacucucgucuccccaguuucugugugcaauuucaagggaaaccuacaaacugaggucccagggcaacaccaacaauaccagcuacaguuaacuaaccuugauggcucacccauugaucccacugaugacacaccuggaccacuggguugcccagacuucauuggccuccucuacgggguugcuagccagcgugguccaggugacgccacgcgggcccaugaggcaaggauugacaccggcagugacacuuaugcccccaaaauuggucaggucagauucuacucaacuucaaacaauuuugaaacaaaccaacccacacacuucaccccagugggggucuacauugagggcaguucuucugacuuuaaucaauggcaacuccccagguauggaggucaucuagcuaauaacaaucacuuggcaccugcaguuucaccucuauucccuggagagcaaauccuuuucuucagaucauucaucccaggagccaguggccacacaaauggggagauggauugccuccugccccaggaguuugugcagcacuucuaccaagaagcggcaacugcgcagucagagguggcccuacugagguuugucaacccugacacuggaaggguuuuguuugaguccaaacuccacaagcaaggauucaugacaauugcaaguucaggugaccauccuaucauuaugccaaccaaugguuauuuuagauuugaagcuuggguuaaccaauuuuauucucuugccccugugggaacuggaagugggcguagaaggauccaguaa

SEQ ID NO: 5828 - RNA, 1623 nt, Artificial Sequence
  capsid__Norovirus__ABL74387
augaagauggcgucgaaugacgccaccccaucugauggguccacagccaaccucgucccagaggucaacaaugagguuauggcuuuggagcccguuguuggugccgccauugcggcacccguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccgggaagaucauauuugcagcagucccaccaaauuucccaacugaaggcuugagccccagccaggucacuauguucccccauauaauaguagauguuaggcaacuggaaccuguguugauccccuugccugauguuaggaacaauuucuaucauuacaaucaaucaaaugaccccacuaucaaauugauagcaaugcuguauacaccacuuagggcuaacaaugcuggggacgaugucuucacagucucuugucgaguucucacgagaccaucccccgauuuugauuucauauuucuggugccacccacaguugagucaagaacuaaaccauucucugucccaaucuuaacuguugaggagaugaccaauucaagauucccuauuccuuuggaaaaguuguucacgggucccagcagugccuuuguuguucaaccacaaaauggcagaugcacgacugauggcgugcucuuagguacuacccaacugucuccugucaacaucugcaccuucagaggggaugucacccacauugcagguacucaaaauuacacaaugaaucuggccucccaaaauuggaacaauuaugacccaacagaagaaaucccagccccucuuggaaccccagauuuuguaggaaagauccaaggcgugcucacccaaaccacgaggagggauggcucgacccguggucacaaagccacagugagcacuggaaguguccacuuuaccccaaaguugggcaguguucaauucuccacugauacaagcaaugacuuugaagcuggccaaaacacgagauucaccccagucggugucguccaggaugguagcaccacccaccaaaaugaaccccaacaaugggugcucccagauuacucagguagagauagucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguuuuguuugagugcaagcuucauaagucaggcuauguaacaguggcuuacacuggccaacaugauuugguuaucccccccaauggcuauuuuagauuugauuccugggucaaccaauucuacacacuugcccccaugggaaauggagcggggcguagacgugcauuauaa

SEQ ID NO: 5829 - RNA, 1623 nt, Artificial Sequence
  capsid__Norovirus__ABL74389
augaagauggcgucgaaugacgccaccccaucugaugggucuacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggggaguuuacaguauccccuagaaacgcuccaggugaaauauuauggagcgcacccuugggcccugauuugaaucccuaccuuucccauuuggccagaauguauaaugguuaugcaggugguuuugaagugcagguaauccucgcggggaacgcguucaccgccggaaaaaucauauuugcagcagucccaccaaauuucccaacugaaggcuugagcccuagccaggucacuauguucccccauauaauaguagauguuaggcagcuggaaccuguguugaucccccugccugauguuaggaacaauuucuaucauuacaaccaaucaaaugaccccaccaucagauugauagcaaugcuguacacaccacuuagggcuaacaaugcuggggacgaugucuucacagucucuugucgaguucucacgagaccaucccccgauuuugauuucauauuucuggugccacccacaguugagucaagaaccaaaccauucucugucccaaucuuaacuguugaggagaugaccaauucaagauucccuauuccuuuggaaaaguuguucacgggccccagcagugccuuuguuguucaaccacaaaauggcagaugcacgacugauggcgugcucuuagguacuacccagcugucuccugucaacaucugcaccuuuagaggggaugucacccacauugcagguacucaaaauuacacaaugaaucuggccucccaaaauuggaacaauuaugacccaacagaagaagucccagccccucugggaaccccagauuuuguaggaaagauccaaggcgugcucacccaaaccacaaggggggauggcucgacccguggucauaaagccacagugagcacuggaaguguccacuuuaccccaaagcugggcaguguucaauucuccaccgauacaagcaaugacuuugaaacuggccaaaacacgagauucaccccagucggugucguccaggaugguaguaccacccaccaaaaugaaccccaacaaugggugcucccagauuauucagguagagauaaucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaacccagacacagguagaguuuuguuugagugcaagcuucauaagucaggcuauguaacaguggcccacacuggccaacaugauuugguuauuccccccaauggcuauuuuagauuugauucuugggucaaccaguucuacacacuugcccccaugggaaauggagcggggcguagacgugcauuauaa

SEQ ID NO: 5830 - RNA, 1623 nt, Artificial Sequence
  capsid__Norovirus__ABL74397
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcaggcucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcgcaggcgugcuuuauaa

SEQ ID NO: 5831 - RNA, 1593 nt, Artificial Sequence
  capsid__Norovirus__ABQ44562
augaugauggcgucuaaggacgcuacgucaagcguggauggcgccaguggcgcuggucaguugguaccggagguuaaugcuucugacccucuugcaauggauccuguggcggguucuucaacagcaguugcaacugcugggcaaguuaacccuauugacccuuggauaaucaauaauuuugugcaggcuccccaaggcgaauuuacuauuucuccaaauaauacccccggugauguuuuguuugauuugaguuuaggcccucaucuuaaucccuucuugcuacauuugucucaaauguauaauggcuggguuggcaacaugagaguuaggauuaugcuggcugguaaugcauuuacugcagguaaaauuauaguuucuugcauaccuccuggcuuuggcucccacaaucuuacuauagcacaagcaacucuuuucccacaugugauugcugauguuaggacuuuagauccaauugaaguacccuuagaagauguaaggaauguucucuuucauaauaaugauaggaaucaacaaacaaugcgucuugugugcaugcuuuauaccccccuccgcacugguggcgguacaggugauucuuuugugguugcugggcgaguuaugacuuguccuagccccgauuucaauuucuuauuuuugguuccucccacaguagaacagaagaccaggccuuucacucucccaaauuuaccgcuaaguucuuugucaaauucacgugcuccucuuccaauuaguggcauggguauuucuccagacaauguucagagugugcaguuccaaaauggccgguguaccuuagaugggcgacuuguugguaccaccccagucucccucucccauguugcuaagauaagggguacuucuaaugguacugugaucaaucucacugaauuggauggcacccccuuccauccuuuugaaggcccugccccuauugguuucccagaucuugguggcugugauuggcauauuaacaugacacaauuuggacauucuagccagacucaguaugauguagauaccacccccgacaccuuuguuccccauuuagguucaauccaggcgaauggcguuaguaguggcaacuacauugguguucuuagcuggguaucccccccaucacauccaucuggcucccaaguugaucucuggaagauccccaacuaugggucuagcaucacagaggcgacccaucuagcucccucugucuauccuccugguuuuggagagguacuagucuuuuucaugucaaagauaccagguccuggcgcuuauagucuacccuguuuacugccacaagaauauauuucacaccuugcaagugaacaagcccccacuguuggugaggccgcccugcuccacuauguugacccugacacaggccggaaucuuggggaguuuaaggcuuaccccgaugguuuccuaaccugugucccuaauggggccagcucgggcccacaacaacugccaauuaauggagucuuugucuuuguuucauggguguccagauuuuaucaguuaaagccugugggaacugccagcacggcaagagguaggcuugguuugcgccgauaa

SEQ ID NO: 5832 - RNA, 1638 nt, Artificial Sequence
  capsid__Norovirus__ABQ44563
augaugauggcgucuaagggcgccccaacaaacauggauggcaccaguggugccggccagcugguaccagaggcaaacacagcugagccuauaucaauggagcccguggcuggggcagcaacagcugccgcaaccgcuggccaaguuaauaugauugaccccuggauaaugaauaauuaugugcaagccccucaaggugaauucaccauaucgccuaacaacacaccaggugauauuuuguuugauuuacaauuaggcccccaccuuaacccuuucuuaucccauuuggcccaaauguauaauggcuggguuggcaauaugaaagugaagguuuuauuggcugguaaugccuucacggcugguaaaauaauuauuaguugcauacccccuggcuuuguugcacaaaauauuucuaucgcucaggcuacuauguucccccaugucauagcugauguuaggguuuuggaacccauugaggugccauuggaagaugugaggaaugugcuguuccauaacaaugacaacacaccaaccaugagguuggugugcaugcucuacacccccuugcgagccaguggcagcucgucuggaacugaccccuuugugauugcugggcguguuuugacaugcccgagcccugauuuuagcuuuuuguuuuuggucccccccaauguagaacaaaagacuaaaccuuuuagugucccaaaucuuccauugaauacucuuucaaauucgagagucccuucucuaaucaaaucaaugaugguauccagggaccaugggcagaugguucaguuucaaaaugguagggucacccuagaugggcaacugcaaggcaccacgcccacaucagcuagccagcugugcaaaaucaggggcagugucuuccaugcuaauggugggaauggguauaaccuaacagaacuggaugggagcccauaccaugcauuugagagccccgcaccaauaggguuuccagaccuaggugaaugugacuggcacauggaggcuuccccuaccacccaauucaauacuggugauguuauaaaacaaaucaaugucaaacaagaaucagcauuugccccccaccuugguacuauacaggcagacggccugagugaugugagugucaacaccaacaugauagcuaaauuagaaugggugucacccgucagugauggacacaaaggagaugucgauccgugggucaucccacgcuaugggucgacuuugacugaggccgcccaauuagccccuccaauauaucccccagguuuuggugaggccauuguguuuuucaugucagauuucccuauugcccaugguaccaauggcuugagugugccuugcaccauaccccaagaauuugucacccauuuugucaaugaacaggccccuacuagaggggaagcagcccuauuacauuauuuggauccugauacucauagaaaucuuggugaauuuaaauuauauccugauggcuucaugacgugugugccuaacucuaguggcacugguccacaaacucuuccaaucaauggugucuuuguuuuuguguccuggguuuccagauuuuaucaauuaaagccugugggaacagccggcccggcucguaggcuugggauuaggagaucauaa

SEQ ID NO: 5833 - RNA, 1635 nt, Artificial Sequence
  capsid__Norovirus__ABQ44564
augaugauggcgucuaaggacgcuacaccaagcgcagauggcgccacuggcgccggccagcugguaccggagguuaauacagcugacccuauacccauugacccuguggcuggcuccucuacagcacuugccacugcaggccagguuaauuugauugaucccuggauaaucaauaauuuugugcaagccccccagggugaauucacaauauccccaaauaauacccccggugaugugcuuuuugauuugcaguuaggaccucauuuaaacccuuuccucucccaucucucucagauguauaauggcuggguaggcaacaugcgagugcguguugucuuggcugguaaugcuuucacggcugggaagguuauaauuugcuguguccccccugguuuucaaucucgcacucuuuccauagcucaggcuacuuuauuuccccacgucauugcugauguuaggacccuugacccuguagaagugccucuugaagauguuaggaauguguuguaucauaauaaugacacccaaccuaccaugcgccuccuuugcauguuguacacuccucuccgcaccgggggagcgucuggugggacugauucuuucgugguagcugggcgugugcuuacuugcccaggcccugacuuuaacuucuuauucuuagucccuccuacagucgagcaaaagacucgcccuuucacugugccuaauaucccuuugaaguaucugucuaacuccagaaucccaaaccccauugaagguaugucauugucaccugaccagacucaaaauguccaauuccagaauggcaggugcacaauugacggucaaccccucgggaccacaccugucucgguuagccaguuauguaaguuuagggguaggauuacaucuggacagaaggugcucaauuugacagaguuggaugguucaccuuuuauggccuuugcugccccugccccugcgggcuucccagaucuuggguccugugauuggcauauugaggugaguaaaaucccaaauucuagcacccagaguaauccaauaguggucaauucugucaagcccaauagucaacaguuugucccacacuugucaagcaucacccuugaugacaauguuucuagugggggugauuauauugguacuauacaauggaccucuccuccuucugauucuggcggagccaauacaaacuuuuggaaaaucccugacuaugggucuagccuggcugaagcuucacagcuggcccccgcugucuauccaccuggcuuuaaugaggugauuguguauuuuauggcaucuauaccuggccccaaucaaucuggguccccuaacuuggugccaugccuacucccccaggaauauauaacgcauuucauuagugagcaggcccccauucagggugaggcugccuuacuccauuauguggacccagacaccaaucguaauuugggugaguuuaaauuguauccuggugguuauuuaaccuguguuccuaauaguucuaguacuggaccucagcagcuuccucuugaugguguauuugucuuugcuucuuggguuucuagauuuuaucaauuaaagccugugggaacagccggaccggcuagagguaggcuugguguccguagauaa

SEQ ID NO: 5834 - RNA, 1623 nt, Artificial Sequence
  capsid__Norovirus__ABQ44565
augaugauggcgucuaaggacgccccaacauccccugauggcgcuaguggcgccggccagcugguaccggaggcuaauacagcugagcaaauuucaauggacccuguugcgggugcuucaacagcagucgcaacggcuggacaaguuaauaugauugacccauggauuuuuaauaacuuuguccaggcaccccaaggagaauucacuauuuccccuaauaauacccccggugauauuuuguuugaucuacaauuaggaccccaccuuaacccauuuuuggcucaucuuucgcagauguacaauggauggguuggcaauaugcguguacgcauauugcuggcagggaaugcuuuuacagcuggaaagauaauuaucugcuguguucccccugguuuugaugcuagaauacucacaauugcucaggcaacucuuuucccacaccugauugcugauguuaggacucuugagcccguggaacucccucuggaggacgugcgcaacguucucuuucacaauagcagccagccgcaaccaacaaugcgauugguggccauguuguacaccccacuccgcacgggcggugguucuggaggcacugaugccuuugugguggcagguaggguacuuacgugcccugccccugacuuuagcuuuuuguuucuuguccccccuucugucgagcaaaagaccaggguauucagugucccuaauguaccucugaaagaccuuucaaauucucgugucccugugccuauacaggguauguuuauguccccagaugucaaccagucaguccaguuucagaaugggcgcugucagauugauggccagcuccagggcaccaccccuguuucgcucagccagcuuugcaagaucagggguaagaccucgagcaaugccagagugcucaaucucagugagguagaugguucaccuuucaucccccucgaaucgccagcaccaguuggcuuucccgaucugggaggcugcgacuggcaugugaauuuuacuuuccaggcucaggaccaagacccaucccaaagugugaccuuugcaaccaaugaugcuagcuuuguuccauaccuaggcaguaucucuccccacaacgggggagauuuucauucaggugacaucauagguagccuuggcuggauuucugccccauccgacaguucccaacucaaugucuggacaauaccgaaguacggcuccagccucccagauguaacccaccuugcaccugcuguguuucccccaggcuuuggggagguuaucuuguacuucuacuccacuuuuccaggcucuggccaaccagggcaacuccaagucccaugucuauuaccucaggaguuuaucacucacuuuugcaaugaacaggcccccauugcuggggaggcugcccuccuccauuauguggauccugauacagggcgaaacuugggggaguucaagcuuuaccccgauggauucaugacuugugucccuaauaguguuaguaguggcccucaaacucuccccaucaauggagucuuugucuuuguuucaugggugucuagauucuaucaacuuaagccugugggaacggccucaguggccagaaggcuuggacuacggcgcauauaa

SEQ ID NO: 5835 - RNA, 1635 nt, Artificial Sequence
  capsid__Norovirus__ABQ44566
augaugauggcgucuaaggacgccccaacaaacauggauggcacuaguggugccggucagcugguaccagaggcaaauacagcugaaccuauaucaauggacccaguggcuggagccgcaacagcgguugcaacugcuggacaaauuaauaugauugaccccuggauaaugaguaauuuugugcaggccccacaaggggaguuuaccgucucaccaaauaacaccccuggagauguuuuauuugaucuacaauugggaccucaauuaaauccauuccucgcccaucuagcccaaauguauaaugguuggguaggcaauaugcgcgugaaggugcugcuugcuggcaacgcuuuuaccgcagggaaaauaauaauuaguugcauacccccaggcuucaccucccagaacauuuccauugcucaaaugacaauguucccucaugucaucgcugacgugaggguuuuggaaccuauagaaguaccccuugaggaugugaggaaugugcuguuucacaccaaugacaaccguccaacaaugaggcucguguguauguuguacacccccuugcgagcuaauggcaguucuucuggcacggacccuuuugucauagcugguaggguucuuacuugcccggauucaaauuuuaguuuccuauuuuuaguacccccuaauguagaacaaaagacuaggccuuuuaguguccccaacauaccuuugaacacauugucaaauucgagggugccaucauugaucaagucuaugacuaucucuagagaucagaaucagauaauucaguuccaaaauggcagggucacauuggauggucagcugcagggcaccacaccuacaucagugagccaauuguguaaaauuagaggcacuacauaucacgcaacuggagguaaugggauaaauuuaacagaguugaauggugaaccauaccaugccuuugaaagccccgccccaauaggauucccagaucuuggugguugugauuggcaucucacugcaacccccacgcaagcuuucaacgauggagcgaaggucgugcgccugucagucacccagggcgcagcuuuugccccacauuuagguaccauacauuacaccacuacugauacugauuauagccccaacacuaguauaauuugcacacuagauuggcugucccaaacuacuggccagagcaauguugaccccuggcagauaccaacuuaugggucgacuuuaacugaagccgcccaguuggcaccucccaucuuucccccuggguuuggagaaacauuggucuucuucuuaucagauuuuccuauuuccaauggcaaaaauggacucaguguaccgugcacccucccacaggaauuugucacccacuuugugaaugagcaggccccaaucagaggagaggccgcucuuuugcauuauguugauccugacacucaccgcaaucuuggagaguuuaaauuguauccagaagguuuuaugacuuguguuccuaauacuagugguggugguccucaaacuuugccuauuaauggagucuuugucuuuguuucuugggucucucgcuuuuaccaguugaagccugugggaacggccggugcggcucguaggcuuggaaucaggaggucauaa

SEQ ID NO: 5836 - RNA, 1608 nt, Artificial Sequence
  capsid__Norovirus__ABQ44567
augaagauggcgucgaaugacgccgcuccaucuaaugauggugcagccggucucguaccagaggucaacaacgagacgauggcacucgaaccgguggcuggggcuuccauagccgccccucuaaccggucaaaacaaugugauagaccccuggauuagaaugaauuuuguccaagccccaaauggugaauuuacagugucuccccguaacucuccuggugaaauucuguuaaauuuagaauuagguccugaauuaaauccauucuuagcacaccuuucaaggauguacaaugguuaugcuggugggguugaagugcaggugcuacuugccgggaacgcguucacagcaggaaaacuaguguuugcagcaauucccccacauuucccuauugagaaccuuaguccugggcaaauuacaauguucccccaugugaucauugauguuaggacauuagaaccuguacuuuugccccucccagauguuaggaauaauuucuuucauuauaaucaggagccugagccccguaugaggcuuguugcuauguuguauaccccccuuaggucuaaugguucuggugaugauguguuuacaguuucuuguaggguucuuacucgcccuuccccagauuuugauuuuaauuauuugguucccccaacuguugagucuaaaacuaaaccauucacccuaccaauccugaccauuggagaauugucaaauucuagguucccagcuccaauugaugaacuguauaccagucccaaugaggguuugguuguccaaccccaaaacggcagaucaacacucgacggugaacuguugggcaccacccaacucgugcccucaaauauuugcucacugcgaggacgcaucaaugcccacuuaccagacaaccagcaccguuggaacaugcaggucacaaaugcaaauggaacuccauucgaccccaccgaagauguuccugcaccgcuggguacaccagacuuccuagcgaacaucuauggagucaccagucagaggaaccccgacaacacuugucgcgcccaugauggaauuuuggcgacuuggagccccaaauucacacccaaacuggggucugugguccugggcacuugggaagacagagauuuugacauaaaccaacccacgagguuuacaccuguugguuuguaugacacugaucacuuuaaucaaugggcuuuaccaaauuauucuggagcgcugacucuaaacaugaauuuggcacccucugucgccccccucuucccaggugagcaguuacuuuucuucaggucccauauaccacucaaaggaggcaccucuaguggugcuauugauugucuacucccucaggaauggguucagcacuuuuaccaggagucagcuccauccucuacugacguggcucugaucagguacaccaacccugacacaggacgcguuuuguuugaggccaaauugcacaggcagggauuuaucacaguggcaaacucuggcuccagacccauuguuguccccccaaauggcuauuuuagauuugauucuuggguuaaucaauuuuauucucuugcccccaugggaacugggaacgggcgcagaagagugcaguga

SEQ ID NO: 5837 - RNA, 1629 nt, Artificial Sequence
  capsid__Norovirus__ABQ44568
augaacauggcgucgaaugacgccgcuccaucuacugauggugcagccggccucgugccagaaaguaauaaugaggucauggcucuugaacccguggcuggugccgcuuuggcagccccggucaccggccaaacaaauauuauagacccuuggauuagagcaaauuuuguccaggccccuaauggugaauuuacaguuucuccccguaaugccccuggugaagugcuauugaaucuagaguuggguccagaauuaaauccuuaucuggcacauuuagcaagaauguacaacggguaugccggugggauggaggugcaggucauguuggcugggaacgcguucacagccggcaaguuggucuucgccgcugugccaccucauuucccgguugaaaaccuuaguccacagcaaauuaccauguucccucaugugauuauagauguaaggacuuuggaaccuguuuuauuaccacucccugauguuagaaauaauuucuuucauuauaaucagaaagaugaucccaaaaugagaauuguggcuaugcuuuauaccccccuuaggucuaaugguucaggugaugauguguuuacagucuccugcaggguguugacuagacccucuccugauuucgauuucacauaccuggugccaccaacaguggaauccaaaacaaaaccauuuacccuuccaauccucacacuuggggagcuuuccaauucuagauuuccagugucuauagaucagauguauacuagccccaaugaaguuauaucugugcagugucaaaaugguaggugcacacuggauggggagcuccaaggaacaacacaacuccaggucaguggcauuugugccuucaagggagaagugaccgcccacuugcaugacaaugaucaccuauauaaugucaccauuacaaacuugaauggguccccuuuugaccccucugaggacauccccgccccucugggcgugccugacuuccagggaagggucuuuggugucaucucccaaagagacaaacagaaugccgcuggacauaaugagccagcaaacagggggcacgacgcuguggucccuacuuacacagcacaguacacuccaaaauuaggucaaauucaaauuggcacauggcagaccgacgaucucacagucaaucaaccaguuaaguuuaccccaguuggccucaaugauacugagcauuuuaaccaauggguggucccuagguaugcuggugcucuaaaucuuaacacaaaucuugccccuucuguugcuccaguguuuccaggggagcgccugcucuucuucagaucauauaucccccucaagggugguuauggaaauccagccauugauugccuacuaccacaagagugggugcaacauuucuaucaggaagcagccccuucaaugagugagguggcccuugucagguacaucaacccggacacuggucgggcacuguuugaggccaagcuccauagagcugguuucaugacggucucaagcaacaccagugcuccggugguugugccugccaacggauacuucagauuugacucuugggugaaccaauuuuauucucucgcccccaugggaacuggaaaugggcguagaaggguccaauaa

SEQ ID NO: 5838 - RNA, 1647 nt, Artificial Sequence
  capsid__Norovirus__ABQ44569
augaagauggcgucgaaugacgcugcuccaucuaaugauggugccgccggccucgucccagagaucaacaaugaggcaauggcgcuagacccaguggcgggugcagcgauagcagcaccccucacuggucagcagaauauaauugaucccuggauuaugaauaauuuugugcaagcaccugguggugaguuuacaguguccccuaggaauuccccuggugaagugcuucuuaauuuggaauugggcccagaaauaaaccccuauuuagcccaucuugcuagaauguauaaugguuaugcagguggauuugaagugcagguaguccuggcuggaaaugcguuuacagcaggaaagauaaucuuugcagcuauacccccuaauuuuccaauugacaaccugagcgcagcacagaucacaaugugcccgcaugugauuguggaugucagacaguuggaaccggucaaccuuccgaugccugacguucgcaacaauuucuuucauuacaaucaagggucugauucgagauugcgcuuaauugcaaugcuguauacaccucuuagggcaaauaauucuggggaugacguuuuuacugugucauguagaguguugacuaggccuagcccugacuuuucauuuaauuuccuugugccaccuacuguggagucaaagacaaagcccuucacccuuccuauucugacuauuucugaaauguccaauucuagguuuccagugccgauugauucucugcacaccagcccaacugagaauauuguuguccagugccaaaacgggcgcgucacucuugauggugaguuaaugggcaccacccaacucuuaccgagucaaaucugugcuuucaggggcgugcucacccgaucaacaagcagggccagugaucaggccgacacagcaaccccuagguuguuuaauuauuauuggcacauacaauuggauaaucugaauggaacaccuuaugauccugcagaagacauaccaggcccccuaggaacaccagauuuccggggcaaagucuuuggcguggccagccaaagaaaccccgauagcacaacuagagcacaugaagcaaagguggacacaacagcuggucguuucaccccaaaauuaggcucauuagaaauauccacugaaucugaugacuuugaccaaaaccaaccaacaagauucacuccaguuggcauugggguugaccaugaggcagacuuucaacaauggucuuuacccgacuauucuggccaguucacccacaacaugaacuuggccccagcuguugcucccaacuucccuggugagcagcuccucuucuuccgcucacaguuaccaucuucuggugggcgauccaacgggauucuagacugccugguuccccaagaauggguucagcacuucuaccaagaaucggcccccgcccaaacacaaguagcccugguuagguaugucaacccugacacugguagaguauuauuugaggccaagcugcauaaauuagguuucaugacuauagcuaagaauggugauucuccaauaacuguuccuccaaauggauacuuuagguucgaaucuugggugaaccccuuuuauacacucgcccccaugggaacugggaaugggcguagaaggauucaauaa

SEQ ID NO: 5839 - RNA, 1623 nt, Artificial Sequence
  capsid__Norovirus__ABQ44570
augaagauggcgucgaaugacgcugcuccaucaaaugauggugccgccggccucgugccagaaaguaauaaugaggcaauggcucuggaacccgugaugggggcgucuuuagccgccccugucacuggccaaacuaauauaauagaccccuggauuagaacuaauuuuguccaagccccuaauggugaauucacaguuuccccuagaaauuccccuggagagauauuggucaauuuggaguuggguccagaacugaauccuuaucuggcacauuuggcuaggauguacaaugguuaugcgggugguauggaggugcaagugaugcucgcggggaacgcguucaccgcuggcaagaucaucuuugccgccgugccaccuuacuuuccaguggaaaaucuuagcccuucccaaauaacaauguucccacaugugauaaucgauguuagaaccuuggaaccuguauugcucccaaugccugaugucagaagcacccuuuuccacuuuaaucagaaggaugaacccaagaugagacuuguugccaugcuuuacaccccucuucguucuaaugguucuggugacgacguuuucaccgucucauguaggauucucacuaggcccuccccugaauuugauuuuacauauuuggugccaccaacaguggaaucaaagacuaagccauuuacacuaccugugcuaacauugggagaacuguccaacuccagauuuccucucucuauugaugaaauggucaccagucccaaugaguccauaguuguucagccacagaaugguagggucacauuagauggggagcugcuaggcacaacccaacugcaagcauguaacauuugcuccauaagggggaaggugacagggcaggucccuaaugaacaacacauguggaaccuggaggucacaaaccuaaaugggacgcaauuugacccuacagaugaugucccagccccccuuggugugcccgauuuugcgggugaggucuuuggugugcucagccagagaaacagaggcgaaagcaacccagcaaacagggcucaugaugcugucguggccaccuacagugacaaguacaccccuaaauugggcuuagugcaaauuggaaccuggaacaccaaugauguugaaaaccaaccaacaaaauucaccccaauugguuugaaugaggucgcuaauggccaucgauuugaacaguggacuuugccuagguauuccggugcccugacauuaaauaugaauuuagccccugcuguggccccgcucuuuccuggagagcgucuccucuucuuccgcucuuacaucccauuaaaagguggauuuggaaacccugcuauagauuguuuggugccucaggaguggguccaacauuucuaucaggaguccgcccccucucugggggauguggccuuagucagguacgucaacccagacaccgggcguguccuuuuugaggccaaacuccacaaagguggguuccugacugugucaaguacuagcacagggccuguuguggucccagccaauggcuauuucagauuugacuccuggguuaaucaauuuuauucucuugcccccaugggaacugggaaugggcgcagaagguuucaguaa

SEQ ID NO: 5840 - RNA, 1653 nt, Artificial Sequence
  capsid__Norovirus__ABQ44571
augaagauggcgucgaaugacgccgcuccaucgaaugauggugcugccaaccucguaccagaggccaacaaugagguuauggcacuugaaccggugguaggagccucaaucgcggcuccuguugucggucagcaaaauauaauugaccccuggauuagagaaaauuuuguccaagcaccacagggcgaguuuacuguuucgccaaggaauucgccuggugagaugcuuuuaaaccuugaguugggcccagaacuuaaccccuauuugagucauuugucccgcauguacaacggauaugcugguggcaugcagguucaggugguccuagcugggaaugcguucacagcugggaaaaucaucuuugccgccguaccaccacauuuuccuguggauaauauuagugcagcccagauaacuauguguccccaugugauuguugaugugagacagcuugaaccagugcuucugccccuccccgauauaaggaauagguucuuccauuacaaucaggagaacaccccccggaugagacucguggccaugcucuacacgccccugagggccaauucuggugaagacguguucacugugucuuguaggguuuugacucgccccgcuccagauuuugaguuuacauucuuaguaccaccaacuguugaaucaaaaacaaaaccuuuuacccuaccuauucuaacucuuggugaguugucuaacucccguuuuccggcugcuauagauaugcuuuauacugaucccaaugaaucaauaguuguucaaccccaaaaugguaggugcacccuugauggcacauugcaaggcacaacacaauugguuccaacacagauuugugcuuuuagaggcacccugaucagccagaccgcgagagcggccgacucaacagauucuccccagagagcccgugaucauccauuacacguccaggucaagaaccuagacggcacacaguaugacccaacagaugacauaccugcaguccugggggcuauugacuucaaaggcacaguauuuggaguggcuagucagagggaugucucuggaccacaagaacagggccacuaugccacccgagcccaugaagcacacauugauacaacugacccaaaguaugcacccaaauuaggcacaauucuuaucaaaucugaauccaaugauuucaucacaaaucaacccauuagguucacuccagugggcaugggugauaacaauuggagacagugggaauuaccugauuauucuggcagauuaaccuuaaauaugaaccuugcccccgcuguuuccccaucuuucccuggugaacgaauccuuuucuuuaggucuauaguaccaucagcuggaggcuacgggucuggcuauauagacugucucauaccccaggaaugggugcaacacuucuaccaggaagcagcaccuucacaauccgcugucgcacugguuagguauguuaaccccgauacugggcguaacaucuuugaggccaaguugcacagagaaggguuccucaccguggccaauucuggaaacaauccuauuguaguucccccuaaugguuauuuuagauuugaggcuuggguuaaucaguuuuacacacuugcccccaugggaucuggacaggggcguagaagggcccaguaa

SEQ ID NO: 5841 - RNA, 1623 nt, Artificial Sequence
  capsid__Norovirus__ABQ44572
augaagauggcgucgaaugacgcagcuccaucuagugauggugcagcaggccucguaccagagaucaauaaugaggucaugccccuugaucccguggcuggugcaucgcuggcgacaccagucgucgggcaacaaaauauaauugaucccuggauaagaaauaauuuugugcaggcuccugcaggugaguuuacuguuuccccuaggaauuccccuggagaaauuuugcuugauuuggaauugggaccagaauugaaccccuaccuugcccaucuggcccgcauguauaaugggcacgcugguggcauggaagugcaaauugugcuggcugggaaugcguucacagcaggcaaaaucauauuugcugccauccccccaggguucccauaugaaaacuugucaccuucucaaauuacaaugugcccacauguuauaauugauguuaggcaauuggagccaguccuuuugccuaugccagauauuaggaacaauuucuuccauuauaaucagggcaaugauccaaaauugaggcuaguugcuaugcucuauacuccuuugagggcuaauaauucuggugaugauguguucacaguuucuuguagggugcucacaaaaccuucacccgacuuugaauucacauuucuaguuccccccacagucgagucuaagacuaagcaauucacucugcccauucucaaaauaucagagaugacuaauucaagauucccaguaccaguggaugugauguacacggccaggaacgagaaccaggucguccaaccacagaauggcagggucacacucgacggugaacuguuggguaccacuccccuguuggccguuaacaucuguaaauuuaagggagaagucauagccaaaaauggggacgugagauccuauagaauggauauggaaaucacuaacacugauggaacaccuauugaccccacagaggacacacccggucccauuggcucaccagauuuucagggcauacuuuuuggcguugccagucagcgcaacaagaaugagcaaaaccccgccacgagggcucaugaagccaauauuaacacugguggagaccaauaugcccccaaacuagcucaagugaaauuuuucucagagucccaagauuuugagguacaccaacccacaaccuuuaccccagucgggguggcgggggacaauucucacccguucagacaauggacacugccacgauauggugggcaccucaccaacaacacccaccuggccccagcaguggcgccgcuguucccgggggagcaguugcuuuucuucaggucacagauacccaguuccgguggucaugaaucggguuacauggauugucuugucccacaagaguggguucaacacuucuaccaggaagcugccacagcucaaucugagguggcccucauaagauucaucaacccagacacugguaggguccuuuuugaggcuaagcuacauaagcaaggcuucauaacuguggcucacaccggugacaacccaauugucaugccaccaaauggguauuucagguuugaagcuugggucaaucaguuuuauucacuugcccccgugggaacugggaaugggcguagaaggguccaauaa

SEQ ID NO: 5842 - RNA, 1608 nt, Artificial Sequence
  capsid__Norovirus__ABQ44573
augaagauggcgucgaaugacgccgcuccaucuaaugauggugcagccggucuuguaccagaggcuaacaaugagaccauggcacuugaaccgguggcuggggcuucaauagccgccccacucaccggccaaaacaauauuauagaccccuggauuagauuaaauuuugugcaggcucccaauggagaguucacgguuucaccccgcaacucgcccggggaaguccuauuaaauuuggaauuaggccccgaacuaaauccauaccuagcacaccuuucuagaauguauaaugguuaugcgggugggguugaggugcaaguacuacuggcugggaaugcguucacagcuggaaaacugguguuugccgcaguucccccucauuuuccauuagaaaauauaagcccuggccagauaacuauguucccucauguaauuauugauguuaggacuuuagaaccaguuuuguugccccuuccugauguuaggaauaauuucuuucauuauaaucagcagaaugaaccgaggaugagacuuguagcaaugcuuuauacuccucuuagaucuaaugguucuggugaugauguauuuacugucuccugcagggugcuuacccgaccuuccccugauuuugauuuuaauuauuugguccccccuacuguugaaucuaaaaccaaacccuucacacucccuaucuugacuauaggggaguuaaccaacuccagguucccugugccuauagaugagcucuacaccagucccaaugagagucugguggugcaaccccagaacgggagaugcgcacuagauggggagcugcagggcacgacucagcuccuccccacggcgaucugcucguucaggggccggaucaaucagaaggugaguggggaaaaccauguuuggaauaugcaggucaccaacaucaacgggaccccuuuugauccaacagaggaugucccgguuccucuaggcaccccagauuucucuggcaagcucuuugguguacuaagccagagagaccaugauaaugccugcaggagucaugaugcaguaauugcaaccaacucugccaaauucaccccaaaauugggcgcuauacaaauuggcacaugggaagaaaacgaugugcacaucaaccaacccacuaaguuuacuccaguuggcuuguuugaagaugaagguuucaaccaguggacacuccccaauuauucuggagccuuaacacuuaaugugggguuggccccuccuguggcccccaccuucccuggugaacaaauucuuuucuuuagaucccacauuccucuuaaaggagguguggcggacccaguuauugauugucucuugccucaagaauggauccaacaucuuuaccaagagucggcccccucacaaucagauguagcacugauuagguuuacaaauccagacacaggacguguucuauuugaagcaaaauuacacaggagugguuacaucacaguggccaauacugguagcagaccgauugugguaccagcuaaugguuacuucagguuugacucuuggguuaaucaauucuauucucucgcccccaugggaacuggaaaugggcgcagaagggugcaauaa

SEQ ID NO: 5843 - RNA, 1614 nt, Artificial Sequence
  capsid__Norovirus__ABQ44574
augaagauggcgucgaaugacgcuacuccaucugaugauggugcagccggccucguaccagagaucaacaaugagguuauggcucuugaacccgucgcuggggccucuauugcagccccuguggucgggcaacagaauauaauugaucccuggauuagaaauaacuuuguacaagccccugcuggugaauuuacaguuuccccuagaaacucuccuggagaacuccuacuugauuuagaauugggcccugaacugaaucccuaucuugcacaccuggccaggauguacaaugggcacgcagggggaauggaagugcagauaguacuggcugggaaugcguucacagcugguaagauccuauuugcugccaucccaccuaguuuccccuaugaaaauuugucacccgcucaauugacuauguguccccaugugauaguggaugugagacaauuagaaccagugcuucugccaaugccagauauaagaaauguuuucuaucacuauaaccagaacaauagucccaaacuuaggcuuguagcuaugcuuuauacuccuuugagagcuaacaacucaggugaugacguguucacgguguccugccgcguuuuaacacgcccuucuccagacuuccaguucaccuuucuggucccaccuacaguugaaucuaaaacuaagaauuucacccuuccuguccucagagucucagagaugacaaauucaaggguuccccguuguuuugggaccaaauguauacaagccaggaaugaaaacaucauuguccaaccccaaaacggcagguguacgacugacggugagcugcuuggcaccacaaccuugcagucugugucuauuugcaauuuuagaggaacaaugcaggcaaagcugaaugaacagccacgauaccaauuacaacucaccaacuuggauggcucacccauagacccaacagaugacaugccugccccucuuggcacaccagacuuucaggccauguuguauggcguugcaagucaacgcuccuccagagacaacgccacuagggcacaugaugcacagauugacacugcgggugacacuuucgccccgaaaauuggccagguccguuucaaaucuagcucuggagauuuugaccuacaugacccuacaaaauucacacccauuggugucaauguggaugaucagcaccccuuuagacaguggucccugccaaacuaugguggucaccuugcccugaacaaucauuuagcccccgcugugacaccacucuucccuggcgagcagauuuuguucuucagaucacacauuccaagcgccggaggccauacagacggugcuauggacugcuugcugccccaagaguggauagagcacuucuaccaggaggcagcuccuucccagucugacaucgcacuggugagguucaucaacccugauacaggaagagugcuccuugaagcuaaguugcacaaacaaggcuuccuuacaguugcagcaucuggagaucaccccauugugaugcccacuaaugguuauuuuagguuugaagcuugggucaaccccuucuacacucucgcccccgugggaacugggucugggcguaggaggauucaauaa

SEQ ID NO: 5844 - RNA, 1641 nt, Artificial Sequence
  capsid__Norovirus__ABQ44575
augaagauggcgucgaaugacgccgcuccaucaaaugauggugcagcuagucucguaccagagggcauuaaugagacuaugccauuggaacccguugcuggugcaucuauugcugccccaguggcgggacaaaccaacauaauugaccccuggauaagaacaaauuuuguacaagccccuaauggagaguuuacagugucaccaagaaauuccccuggagaaauuuuauuaaauuuagaauuaggaccagaucugaauccuuauuuggcccaucuuucaagaauguauaaugguuaugcuggagguguugaggugcaagugcuccuugcugggaacgcguucacagcagguaagauauuguuugcagcaaucccaccuaacuuuccuguagauaugauuagcccagcucaaauuacuaugcuuccccauuugauuguagauguuaggacuuuggaaccuauuaugauacccuugccugauguuaggaauguguucuaucauuuuaauaaucaaccucaaccuagaaugagauuaguggcuaugcucuacaccccauugaggucuaaugguucaggggaugaugucuucacugugucuuguagagugcuaacuaggccaacuccugauuuugaauuuaucuaucuggugcccccuucuguagaguccaaaacuaaaccauucacacuaccaauauuaaccauuucugaauugaccaacucccgguucccuauuccaaucgagcaauuguauacggcuccaaaugagaccaauguuguccagugucagaauggcaggugcaccuuagauggagagcuccagggcacaacccagcuguugucaagugcaguuugcucuuacaggggcaggacuguggccaauaauggggauaauugggaccaaaauuugcuccagcugaccuauccaaauggugcaagcuaugaccccacugaugaagugccggcaccauugggcacucaagauuuuagugggauguuguauggaguguugacccaggacaaugugaaugugagcacaggagaggccaaaaaugcuaagggaauauacauauccaccacuagugggaaauuuaccccaaaaauugggucaauuggauugcauucaauaacugagcacgugcaccccaaccaacagucgcgguucacccccguuggagucgccgugaaugagaacacccccuuccagcaauggguucugccacauuaugcagguagucucgcucucaacaccaauuuggcaccugcuguugccccgacuuucccuggugagcaauugcuguucuucaggucccgugucccauguguccaaggccuacaggggcaggaugcguucauagauugccuccugccccaagagugggugaaucauuuuuaucaagaggcagccccagccccagccccuucccaagcagacgucgcccuuauuagguaugucaacccugauacuggucgcacgcuguuugaagccaaguugcauagaucagguuucauuacugugucacauacuggugcuuacccucuuguaguccccccaaauggucauuuuagguuugauucuuggguuaaucaauuuuacucacucgcccccaugggaacuggcaaugggcguagaaggauccaguaa

SEQ ID NO: 5845 - RNA, 1623 nt, Artificial Sequence
  capsid__Norovirus__ABQ44576
augaagauggcgucgaaugacgccgcuccaucuaaugauggugcagccggucucguaccagaggucaacaacgagacauuggcacuugagccaguugcgggagcuucaaucgccgccccuuuaacuggucaaaacaauguaauagaccccuggauuagauuaaauuuuguacaagcccccaauggugaguucacgguuuccccccgaaacucgccuggugaaauuuuguuaaauuuggaguuagggccugaauugaauccauauuuagcccauuuagcaagaauguauaaugguuaugcaggugggguugaggugcagguacugcuggcuggaaaugcguuuacagcgggcaaauugguauucgcagcaauccccccccauuuuccaguagauaauuugagccccggucagauuaccauguuuccccaugugauuauugauguuagaacacuugaaccuguuuuguuaccauuaccugauguuaggaauaguuucuuccauuacaaucaacagagugaucagcgcaugagacuuauugcuaugcuuuacaccccucuuagaucuaaugguucaggugaugaugucuucacugugucaugcaggguuuuaaccaggccauccccugauuuugauuucaacuauuugguccccccaacaguugaauccaaaacuaaaccuuucucaguuccagugcugacccucaaugagcugaccaacucucgcuuucccgucccgauugaugcuauguacacuagcccuaaugauucaauugugguccaaccccagaaugggagggcaaccauagauggugaguugcuuggcaccacucaacucauccccagugguaucugcucauuuagaggaaaaauuacaacacauuugucagaugauaggcacuuguggaauauccaagucaccaacuugaauggcaccccguucgauccaacggacgaugugccugcaccauuggguaugccagacuuuucugggcaaauauuuggggugguuagccaaagggacacaggcaccaaccccgcaaacagggcucaugaugcuguccuugcaaccuacagugccaaauauacuccuaagcucggaucaguccaaauuggaacuugggacaccgaggauuuacuugaaagacagccuguuaaauuuacgccuguuggucuuaaugaaauuggacaagauaagcacuuugaccaaugggucuugccaaauuauucuggugcccuaggacucaacaugcaccuggcuccugcugugucuccacucuucccaggggagagauugcuguucuuuagaucauacauaccuuuaaaagguggccauggggacccauuuauugauugucuugugccucaagaauggauacaacacuuuuaucaagagucagccccagcacaauccucgguggcucugcugagguaugugaauccagacacaggucgcacccuauuugaggccaaauuacacaaggaaggguuuaucaccgucucuagcacggaaaacaggccugugguuguccccccaaaugguuacuuuagguuugauucuuggguuaaccaauuuuauucauuagcccccaugggaacuggcaaugggcgcagaaggaugcaguaa

SEQ ID NO: 5846 - RNA, 1569 nt, Artificial Sequence
  capsid__Norovirus__ACJ04900
augaagaugacugacagagacacuauugauucugcuccggcgcucggacagguccuccccccugagguugaggcguccguacccguugagccaacagccggcgccccugucgccgcccccacugcugggcaggucaauccaauugacccauggauuuuugccaauuuugugcaagccccucaaggugaauuuaccauaucucccaauaauaauccuggugagauuuuguuugaauuggaacuuggcccugaucugaaccccuauuuggcccaccuccgccgcauguacaauggauggaccggguccaugcgcgugcgaguccuucuagcgggcaacgccuuuucggcgggcaagguggugguguuuuguguuccccccggguuugacacuuccuaccugacuccaucucaggccacccaguucccucacgugcuaauugaugugcgugccccagaaccaguugagaugccccuugaagacguucgcaacauucuuuuccaucaggggccugauucgcgcaugagacucauggggaugcucuacaccccucugcgugccaauuccggugcggaucccuuuguugucaccggccguguucucaccugccccagccccaauuucuccuuuuucuuuuuaguuccccccacuguugaggaaagggagacuccuuucacuuuaccaaaucuaccugugaauagucuuucacauucccgggcuauggaacccauagcccagaugaugagcucccgcaauuuuccagcuucgguucaguuucaaaauggucgcugcacccucuccggcgaucuuuugggcacaacuccaucgucucccgccgacgucggcaccuuugugggcuugaucgcugagcccggcucucacguuguugaauugucccagcccaaucaggaggauuuucaugcugggucugccccugcccccuuuggcuuuccagacuuuuccgacugcucuuugaccuuugugguggccagcgcgucgaccguuggggagcgcacugugaacacccguagcccccagaauuuuacccccgcccucgggcauauuacauuugaugaggaggccccugcugaucuguuucgggcccaucuccggaaccuuugggauccgaccgagcacucguucuggaggauuccggauuaccgggccgacgugcuugguggcgaguuugcccccucugucucugccccugguguuggugaaacccuucuuuucuuuauguguaaugucccucguucaaauggugcuaaucccaaucccugcccuugccugcucccucaggaauggauuacccauuuuguuucugagcgugccgcccuucagagugauguggcacuucuaaauuauauuaaucccaacaccggucggguuuuguuugagugcaagcuauaugcuaauggcuuccucaccguuaaccuuggcgccucagaccaggcgacccuaccgguggaugggauauuuaaguuuguuucuuggguuucuuuuuacuaucagcugcggccugugggaaauauugguguuggccgccgucucccucgucuugauggcuucuga

SEQ ID NO: 5847 - RNA, 1569 nt, Artificial Sequence
  capsid__Norovirus__ACJ04903
augaagaugacugacagagacacuauugauucugcuccggcgcucggacaaguccuccccccugagguugaggcguccguacccguugagccaacagccggcgccccugucgccgcccccacugcugggcaggucaacccaauugacccauggauuuuugccaauuuugugcaagcuccucaaggugaauuuaccauaucccccaauaauaauccuggugagauuuuguuugaauuggaacuuggcccugaucuaaauccuuauuuggcccaccuucgccgcauguacaauggauggaccggguccaugcgcgugcgaguccuucuagcgggcaacgccuuuucggcgggcaagguggugguguuuugugucccccccggguuugacacuuccuaccugacuccaucucaggccacccaguucccucacgugcuaauugaugugcgcgccccagaaccaguugagaugccccuugaagauguucgcaauauucuuuuccaucaggggccugauucacgcaugaggcucauggggaugcuuuacaccccucugcgugccaacucuggcgcggaccccuuuguugucaccggccguguccucaccugcccuagccccaauuuuuccuuuuucuuuuuaguuccccccacuguugaggaaagggagaccccuuuuacuuuaccaaauuugccugugaauagucuuucacauucccggguuauggagcccauagcccagaugaugagcucccgcaauuucccagcuucgguucaguuucaaaauggccgcugcacccucuccggcgaucucuugggcacaaccccaucgucucccgccgaccucggcaccuuugugggcuugaucgcugagccuggcucucauguugcugaauugucucagcccaaucaggaggauuuucaugcugggucugccccugccccuuuuggcuucccagauuuuucugaaugcucuuugaccuuugugguggccagcgcgucgaccguuggggagcguacugugaacacccguagccuccagaauuuuacccccgcccucgggcacauuacauuugaugaggaggcuccugcugauuuguuucgggcccaucuccggaaccuuugggacccgaccgagcacucguucuggaggauuccggacuaccgggccgacgugcuugguggugaguuugcccccucuguuuccgccccugguguuggcgaaacccuucuuuucuuuauguguaaugucccucguuuaaauggugcuaauccuaaucccugcccuugccugcucccucaggaguggauuacccauuuuguuucugagcgugccgcccuucagagugauguggcacuucuaaauuauauuaaccccaacaccggccggguuuuguuugagugcaagcuguauguuaauggcuuccucaccguuaaucuuggcgccucagaccaggcgacccuaccgguggaugggauauuuaaguuuguuucuuggguuucuuuuuauuaucaguugcggccugugggaaauauugguguuggccgccgucuuccccgucuugauggcuucuga

SEQ ID NO: 5848 - RNA, 1569 nt, Artificial Sequence
  capsid__Norovirus__ACJ04906
augaagaugacugacagagacguuacugauuccgcuccggcgcucggacaaguccucccuccugaggucgaggcguccguccccguugagccaacagccggcgcccccgucgccgcccccacugcugggcaaguuaauccaauugacccauggaucuuugccaauuuugugcaagcuccccagggagaguuuaccauaucccccaacaacaacccuggcgagauuuuguuugagcuggaacuuggcccugauuugaaucccuaccuggcccaccuccgccgcauguauaacggguggacugguuccaugcgcgugcgagugcuccuggccgggaaugcuuucuccgcaggcaagguggugguguuuugugucccuccuggguuugauaccuccuaucugaccccaucucaagccacccaguuuccccaugugcugauugaugugcgcgccccagagcccguugagaugccccuugaagauguucguaacauccucuuccaccaggggcccgauucccgcaugagacucauggguaugcuguauacuccccugcgcgccaacucuggugcggaccccuuuguugucaccggccgaguccuuacuugcccuagcccuaauuuuuccuuuuucuuucugguucccccuaccguugaggaaagggagcccccuuuuacuuugccaaauuugccuguuaauaaucuuucacauucccggguuauggaaccgauagcccagaugaugagcucacgcaauuuuccagccucaguccaguuccaaaauggucgcugcacucugucuggcgaccuccugggcacaaccccuucaucuccuuccgaccuaggcgcuuuugugggccugauugccgagccugggucucggguuguugaauugucucagcccaaucaggaagacuuccaugccgggucugcuccugcuccuuuuggcuuuccagauuuuucugauuguucuuuaaccuuuguaguggcuagcgcgaccacuguuggagagcgcacugugaaugcccgcagcccccaaaauuuuaccccugcucuugggcacaucaccuuugaugaggaggccccugcugaucuguuccgggcccaucuccggaaccuuugggacccgacugagcauucauuuuggaggaucccggauuaccgagccgaugugcuugguucugaguucgccccuucugucucugccccagguguuggugaaacucuucucuuuuuuaugugcaaugucccucgcuugaauggcgcuaaucccaauccuugucccuguuugcucccccaggaguggauuacccacuuugucuccgagcgcgccgcccuucaaagcgauguggcgcuuuugaauuauguuaaccccaacaccggucggguccuguucgaggcgaagcuguacgccaauggcuuccucaccgucaaccucggugccucggaccaggcgacccuacccguggacgggauauuuaaauuuguuuccuggguuucuuuuuauuaccaguugcggccugugggaaaugcuaguguuggccgccgccuuccccgucuugauggcuucuga

SEQ ID NO: 5849 - RNA, 1623 nt, Artificial Sequence
  capsid__Norovirus__ACY00565
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccagguuacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaguggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugagcaacuucuuuucuuuagguccacuaugcccggaugcagcggguaucccaacguggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5850 - RNA, 1623 nt, Artificial Sequence
  capsid__Norovirus__ACY00568
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaagucacuauguucccccacauaauaguggauguuaggcaauuggaaccuguguugauccccuuaccugaugucaggaauaacuucuaucauuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacaguuuacacugggagugcccccuuuacuccaaagcuggguaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaaugucccuaauguacaccuagccccugcuguagcccccacuuucccgggugaacaacuccuuuucuuuaggucuacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5851 - RNA, 1623 nt, Artificial Sequence
  capsid__Norovirus__ACY00571
augaagauggcgucgaaugacgccaacccaucugauggguccgcagccaaccucgucccagaggucaacaaugagguuauggcuuuggagcccguugucggagccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccaaccuaucccauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaauguuguauacaccacuuagagcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcuuuuaggcaccacccaacugucuccugucaacaucugcaccuucagaggggaugucacccacauugcagguucucguaauuacacaaugaauuuggcuucucuaaauuggaacaauuaugauccaacagaagaaaucccagccccucuaggaacuccagauuuugugggaaagauccaaggugugcucacucaaaccacaaagggagauggcucgacccguggccauaaagcuacaguuuacacugggagugcccccuuuacuccaaagcugggcaguguucaauucagcacugauacagaaaaugauuuugaaacucaccaaaacacaaaauucaccccagucggugucauccaggaugguggcaccacccaccgaaaugaaccccaacaaugggugcucccaaguuauucagguagaaauguccaaaauguacaccuagccccugcuguagcccccacuuuuccgggugaacaacuucuuuucuuuagguccacuaugcccggauguagcggguaucccaacauggauuuggauugccuacucccccaggagugggugcagcauuucuaccaagaggcagcuccagcacaaucugauguggcucuauugagauucgugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaaugggacggggcguagacgugcuuuauaa

SEQ ID NO: 5852 - RNA, 1623 nt, Artificial Sequence
  capsid__Norovirus__ACY00573
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuugugcaagccccugguggagaguucacaguauccccuagaaacgcuccaggugaaauacuauggagcgcgcccuuaggcccugaucugaaucccuaucuaucucauuuggccagaauguauaaugguuaugcagguggcuuugaagugcaggugauucucgcggggaacgcguucaccgccggaaaaauuauauucgcagcagucccaccaaauuuuccaacugaaggcuugagccccagccaggucacuauguucccccauauaauaguagauguuaggcaauuggaaccuguguugauccccuuaccugauguuaggaauaauuucuaucauuauaaucagucaaaugauucuaccauuaaauugauagcaaugcuguauacaccacuuagggcuaauaaugcuggggaagaugucuucacaguuucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccucuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggcgucauccaggaugguagcaccacccaccgaaaugaaccccaacaaugggugcucccaaguuauucagguagagauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuugguuaucccccccaauggcuauuuuagguuugacuccuggguuaaucaauucuacacacuugcccccaugggaaauggaacggggcgcagacgugcuuuauaa

SEQ ID NO: 5853 - RNA, 1623 nt, Artificial Sequence
  capsid__Norovirus__ACY00576
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuugggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguuuccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuucuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguacucauaacuacacaaugaauuuggcuucucuaaauuggaacaauuacgacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccggucggugucauccaggaugguagcaccacccaccgaaaugaaccccaacaaugggugcucccaaguuauucagguggaaauguccaaaauguacaccuagccccugcuguagcccccacuuuuccgggugaacaacuucuuuucuuuagguccacuaugcccggaugcagcggguaucccaacauggauuuggauugccuacucccccaggagugggugcagcauuucuaccaagaggcagcuccagcacaaucugauguggcucuauugagauucgugaauccagacacggguaggguccuguuugagugcaaacuucauaaaucaggcuacgucacaguggcucacaccggccagcaugauuuggucaucccccccaaugguuauucuagguuugaucccuggguuaaucaauucuacacacuugcccccaugggaaauggaacggggcguagacgugcuuuauaa

SEQ ID NO: 5854 - RNA, 1623 nt, Artificial Sequence
  capsid__Norovirus__ACY00579
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuugggcccugaucugaaucccuaccuaucucauuuggccagaauguauaaugguuaugcaggugguuuugaagugcaggugauccucgcggggaacgcguccaccgccggaaaaauuauauuugcagcagucccaccaaauuuuccaacugaaggcuugagucccagccaggucacuauguuuccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuucuggugccaccuacaguugagucaagaacuaaaccauuuacugucccaauccuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguacucauaacuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccggucggugucauccaggaugguagcaccacccaccgaaaugaaccccaacaaugggugcucccaaguuauucagguggaaauguccaaaauguacaccuagccccugcuguagcccccacuuuuccgggugaacaacuucuuuucuuuagguccacuaugcccggaugcagcggguaucccaacauggauuuggauugccuacucccccaggagugggugcagcauuucuaccaagaggcagcuccagcacaaucugauguggcucuauugagauucgugaauccagacacggguaggguccuguuugagugcaaacuucauaaaucaggcuacgucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5855 - RNA, 1623 nt, Artificial Sequence
  capsid__Norovirus__ACY00582
augaagauggcgucgaaugacgccaacccaucugauggguccguagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaccugaaucccuaccuaucucauuuggcuagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccauaugauaguggauguuaggcaauuggaaccuguguugauccccuuaccugauguuaggaauaacuucuaucacuauaaucagucaaaugauucuacuauuaaauugauagcaaugcuguauacaccacuuagggcugauaaugcuggggaagaugucuucacagucucuugucgaguucucacgaggccauccccugauuuugauuuuauauuuuuggugccaccuacaguugagucaaaaacuaaaccauuuacugucccaaucuuaacuguugaagaaaugaccaauucaagauuccccauucccuuggaaaaauuguucacgggucccagcaguaccuuuguuguucaaccacaaaauggcagaugcacgacugauggcgugcucuuaggcaccacccaacugucuccugucaacaucugcaccuucagaggggaugucacccacauugcagguucucguaacuauacaaugaauuuggcuucucuaaauuggaacaauuaugacccaacagaagaaauuccagccccucuaggaacuccagauuucgugggaaagauccaaggugugcuuacucaaaccacaaagggagacgguucgacccguggccauaaagcuacaguuuacacugggagugcccccuuuacuccaaagcugggcaguguucaauucaguacugauacagaaaaugauuuugaaacucaccaaaauacaaaauucaccccagucggugucauccaggaugguagcaccacccaccgaaaugaaccccaacaaugggugcucccaaguuauucagguagaaauguccauaauguacacuuagccccugcuguagcccccacuuuuccgggugaacaacuucucuucuuuagguccacuaugcccggaugcagcggguaucccaacauggauuuggauugccuacucccccaggagugggugcagcauuucuaccaagaggcagcuccagcacaaucugauguggcucuauugagauuugugaauccagacacggguaggguccuguuugaaugcaaacuucauaaaucaggcuaugucacaguggcucacaccggccagcaugauuuggucaucccccccaaugguuauucuagguuugauuccuggguuaaucaauucuacacacuugcccccaugggaaauggaacggggcguagacgugcuuuauaa

SEQ ID NO: 5856 - RNA, 1623 nt, Artificial Sequence
  capsid__Norovirus__ACY00588
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggcgauccucgcggggaacgcguucaccgccggaaaaauuauauuugcagcagucccaccaaauuuuccaacugaaggcuugagucccagccagguuacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacgaagggagauggcucgacccguggccauaaagcuacaguuuacacugggagugcccccuuuacuccaaagcugggcagucuucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5857 - RNA, 1623 nt, Artificial Sequence
  capsid__Norovirus__ACY00594
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaaucauauuugcagcagucccaccaaauuuuccaacugaaggcuugagucccagccaggucacuauguucccccacauaauaguggauguuaggcaauuggaaccuguguugauccccuuaccugauguuaggaauaacuucuaucauuauaaucagccaaaugauucuaccauuaaauugauagcaaugcuguauacaccacuuagggcuaauaaugcuggggaagaugucuucacagucucuugucgaguucucacgaggccauccccugauuuugauuuuauauuucuggugccaccuacaguugagucaagaacuaaaccauuuacugucccaaucuuaacuguugaagaaaugaccaauucaagauuccccauuccuuuggaaaaauuguucacgggucccagcagugccuuuguuguccaaccacaaaauggcagaugcacgacugauggcgugcucuuaggcaccacccaacugucuccugucaacaucugcaccuucagaggggaugucacucacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggggauggcucgacccauggccauaaagcuacaguuuacacugggagugcccccuucacuccaaagcuggguaguguucaauucagcacugauacagaaaaugauuuugaaacucaccaaaacacaaaauucaccccagucggugucauccaggaugguagcaccacccaccgaaaugaaccccaacaaugggugcucccaaguuauucagguagaaauguccaaaauguacaccuagccccugcuguggcccccacuuuuccgggugaacaacuucuuuucuuuagguccacuaugcccggaugcagcggguaucccaacauggauuuggauugccuacucccccaggagugggugcagcauuucuaccaagaggcagcuccagcacaaucugauguggcccuauugagauucgugaauccagacacggguaggguccuguuugagugcaaacuucauaaaucaggcuaugucacaguggcucacaccggccagcaugauuugguuaucccccccaaugguuauuuuagguuugauuccuggguuaaucaauucuacacacuugcccccaugggaaauggaacggggcguagacgugcuuuauaa

SEQ ID NO: 5858 - RNA, 1623 nt, Artificial Sequence
  capsid__Norovirus__ACY00597
augaagauggcgucgaaugacgccaacccaucugauggguccgcagccaaccucgucccagaggucaacaaugagguuauggcuuuggagcccguugucggagccgcuauugcggcgccuguagcgggccaacaaaauguaauugaccccuggauuagaaacaauuuuguacaagccccugguggagaguuuacaguauccccuagaaacgcuccaggugaaauacuauggagcgcgcccuugggcccugaucugaaucccuaccuaucccauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggguguuaggcaauuggaaccuguguugauccccuuaccugauguuaggaauaacuucuaucacuauaaucagucaaaugacucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcuuuuaggcaccacccaacugucuccugucaacaucugcaccuucaaaggggaugucacccacauugcagguucucguaauuacacaaugaauuuggccucucuaaauuggaacaauuaugacccaacagaagaaaucccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucagcacugauacagaaaaugauuuugaaacucaccaaaacacaaaauucaccccagucggugucauccaggaugguggcaccacccaccgaaaugaaccccaacaaugggugcucccaaguuauucagguagaaauguccaaaauguacaccuagccccugcuguagcccccacuuuuccgggugaacaacuucuuuucuuuagguccacuaugcccggauguagcggguaucccaacauggauuuggauugccuacucccccaggagugggugcagcauuucuaccaagaggcagcuccagcacaaucugauguggcucuauugagauucgugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaaugggacggggcguagacgugcuuuauaa

SEQ ID NO: 5859 - RNA, 1623 nt, Artificial Sequence
  capsid__Norovirus__ACY00600
augaagauggcgucgaaugacgccaacccaucugaugggcccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccaggucacuauguucccccauauaauaguggauguuaggcaauuggaaccuguguugauccccuuaccugauguuaggaauaauuucuaucacuauaaucagucaaaugauucuaccauuaaauugauagcaaugcuauauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccuguuaacaucugcaccuucagaggggaugucacccacauugcagguucuaguaauuacacaaugaauuuggcuucucuaaauuggaacaauuaugacccaacagaagaaauuccagccccucuaggaacuccagauuuugugggaaagauccaaggugugcucacccaaaccacaaagggagaugguucgacccguggccauaaagcuacaguuuacacugggagugcccccuuuacuccaaaguugggcaguguucaguucaguacugauacacaaaaugauuuugaaacccaccaaaacacaaaauucaccccagucggugucauccaggaugguggcaccacccaccgaaaugaaccccaacaaugggugcucccaaguuauucagguagaaauguccaaaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagccccagcacaaucugauguggcucuauugagauuugugaauccagacacggguaggguccuguuugagugcaaacuucauaaaucacgcuaugucacaguagcucacaccggccagcaugauuuggucaucccccccaaugguuauuuuagguuugauuccuggguuaaccaauucuacacacuugcccccaugggaaauggaacggggcguagacgugcuuuauaa

SEQ ID NO: 5860 - RNA, 1623 nt, Artificial Sequence
  capsid__Norovirus__ACY00603
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcgcucaccgccggaaaaauuauauuugcagcagucccaccaaauuuuccaacugaaggcuugagucccagccagguuacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacagucgagucaagaaccaaaccauuuacugucccaaucuuaacuguugaagaaaugaccaauucaagauuccccauuccucuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcccacucaaaccacaaagggagauggcucgacccguggccauaaagcuacaguuuacacugggagugcccccuuuacuccaaagcugggcaguguucaauucaguacugauacagaaaaugauuuugaagcucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaggaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5861 - RNA, 1623 nt, Artificial Sequence
  capsid__Norovirus__ACY00606
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcagaugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaaccaaaccauuuacugucccaaucuuaaccguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacucacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguaccgauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugguuuggucaucccccccaaugguuauuuuagguuugauuccuggguuaaucaauucuacacacuugcccccaugggaaauggaacggggcguagacgugcuuuauaa

SEQ ID NO: 5862 - RNA, 1623 nt, Artificial Sequence
  capsid__Norovirus__ACY00609
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauucccuauuccuuuggaaaaauuguucacggaucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagacuucgugggaaagauccaaggugugcucacucaaaccacaaagggagauggcucgacccguggccauaaagcuacaguuuacacugggagugcccccuucacuccaaagcugggcaguguccaauucaguacugauacagaaaaugauuuugaaacucaccaaaacacaaaguucaccccagucggugucauccaggaugguggcaccacccaccgaaaugaaccccaacaaugggugcucccaaguuauucagguagaaaugucccuaauguacaccuagccccugcuguggcccccacuuuuccgggugaacaacuucuuuucuuuagguccacuaugcccggaugcagcggguaucccaacauggauuuggacugcccacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5863 - RNA, 1623 nt, Artificial Sequence
  capsid__Norovirus__ACY00612
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccagguuacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucaugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacccaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 5864 - RNA, 1632 nt, Artificial Sequence
  capsid__Norovirus__ACY00615
augaugauggcgucuaaggacgccccaacaaacauggauggcaccaguggugccggucagcugguaccagaggcaaauacagcugaaccuuuaccaauaaaaccaguggccggggcugcgacugcgguugcaaccgccggucagguaaauaugauugaccccuggauaaugaauaauuuuguacaggcuccccaaggggaguuuaccauuuccccaaauaauacaccuggugauauuuuauuugauuugcaauuaggaccacaucuuaauccuuucuuggcucauuugucuagaauguauaaugguuggguugggaauaugcagguccgcauaaugcuugcugguaaugccuuuucagcuggaaagauuauugugugcugcauaccgccggguuuuucuucucaaucuauuucuauugcucaagcuacaauguucccacaugucauagcugauguuagaguguuagaaccuauugauguacccuuagaugauguuagaaauguccuuuuucauaauaaugauaacccccaaacgaugagauugcuuugcauguuguauacaccccuucggucuggugguacaucuucagguacagauccuuuugucauugcuggucgugucuugaccugccccacaccugauuuuaguuucuuguuccuugucccuccugauaucgagcaaagaacuaagccauucaguguacccaauaucccuaugaaccugauguccaauucccguguuucaauguugauugaugguaugaugguuucaaaugaucagaaucaagucccccaguuucagaauggucgagucacuuuagauggacagcugcaggauaccaccacaguuucagcugcguguguagcaaggaugaggggacgcauuuuuaauaauaauggcaauuauggugugaaccugacugaacuggauggcaauccuuaucaugccuuugauagcccggcuccuuuaggcuuuccugacuuugggaauugugauuugcacaugaccuuuguuaaaauuaaucccaaugaguuguccucuggagacccuucuggcaaaguggucauucauuccuacgaugccacuuuugccccccaucuugguacugucaaacuggagaaugaugaugagcuagcucgguuuguggguaaggagguaguacuggagcugacguggguuuccaacagagagggugccacccuuaaucuaugggcuguuccaaauuaugguuccaguuugacacaggcgucacagcuugccccaccaauuuaccccccuggguuuggugaggcuauuguguauuucaccucuacuuuuccaacagucagcaacccaaaagucccauguacacuuccucaagaauuuguuucacauuuugucaaugaacaggcccccacacgcggcgaugccgcucuucuucauuauguugauccugacacacaccguaaucuuggagaguuuaagauguacccugagggcuacaugacaugugucccuaaugcugguggugggccacaaaccuuaccaaucaaugguguauuugucuucauuucuuggguuucuagauauuaccaguuaaagccugugggaacugccggugcggcuaggaggcuuggucuuaggagaucauaa

SEQ ID NO: 5865 - RNA, 1623 nt, Artificial Sequence
  capsid__Norovirus__ACY00618
augaugauggcgucuaaggacgccccaacauccccugauggcgcuaguggcgccggccagcugguaccggaggcuaauacagcugagcaaauuucaauggaccccguugcgggugcuucaacagcagucgcaacggcugggcaaguuaacaugguugacccauggaucuucaacaacuuuguccaagcaccccaaggagaauucacuauuuccccuaauaauacccccggugauauuuuguuugaccuacaacuaggaccccaucuuaacccauuucuagcccaucucucacagauguauaaugguugggucggcaauaugcgugugcgcauauuguuggccgggaacgccuucacagcuggaaagauaaucauuuguuguguccccccugguuuugaugcuagaauacucacaauagcucaagcaacucucuucccacauuugauugcugauguuaggacccuugagccuguggagcuuccuuuggaggacguacgcaacguucucuaccacaacaguagccagccgcagccaacaaugcggcugguugcuauguuguacaccccccuccgcacugguggugguucuggaggcacugaugccuuugugguggcggguagggugcuuacgugccccgcccccgacuuuagcuuuuuguuucuuguucccccuuccguugaacaaaagaccagaguuuucaguguccccaauauaccucugaaagaccucucaaauucucgugucccugugcccauacagggcauguuuauguccccagauguuaaucagucaguccaguuucaaaacggacgcugccaaauugauggucaacuccagggcaccaccccagucucgcucagccaacucugcaagauuagggguaaaacuucaagcaaugcuagggugcucaacuuaagugagguagaugguacacccuucaucccucuugaaucaccagcgccaguagguuuucccgacuuaggaggcugugacuggcacguaaauuucacuuuccagacucaagaucgggacccaucucaaagugugaccuuugcaaccaaugaugccagcuuuguccccuacuuagguagugucuccccucacaauggggaagguuuucaagcaggcgacaucauagguagccuuggguggauuucagccccgucugauaauucacaauucaauguuugggcaauaccaaaguauggaucuagucucccagacgucacccaucuugcuccugcuguguuccccccaggcuuuggggaggugauccuauauuucuacucuaccuucccagguucuggacaacccagucaacuucaagucccauguuuguugccucaggaguucaucacccacuucuguaacgaacaggcucccaucgcuggggaggcugcccuccuccacuacguggacccugacacggggcggaacuugggggaauucaaacuuuauccugauggguuuaugaccugugucccuaauaguguuagcaguggcccccagacccuuccuauuaauggagucuuugucuuuguuucauggguguccagauucuaucaacucaagccugugggaacggccucagcggcuagaaggcuuggacugcggcguauauaa

SEQ ID NO: 5866 - RNA, 1623 nt, Artificial Sequence
  capsid__Norovirus__ACY00621
augaugauggcgucuaaggacgccccaacauccccugauggcgcuaguggcgccggccagcugguaccggaggcuaauacagcugagcaaauuucaauggacccuguugcgggugcuucaacagcagucgcaacggccgggcaaguuaacaugauugacccauggaucuucaacaacuuuguccaagcaccccaaggagaauucacuauuuccccuaauaauacccccggugacauuuuguuugaccuacaacuaggaccccaucuuaacccauuucuagcccaucucucacagauguauaaugguugggucggcaauaugcgugugcgcauauuguuggccgggaacgccuucacagcuggaaagauaaucauuugcuguguccccccugguuuugaugcuagaauacucacaauagcucaagcaacucucuucccacauuugauugcugauguuaggacucuugagccuguggagcuuccuuuggaggacguacgcaacguucucuaccacaacaguagccagccacagccaacaaugcggcugguugcuauguuguacaccccccuccgcacugguggugguucuggaggcacugaugccuuugugguggcgggcagggugcuuacgugccccgcccccgacuuuagcuuuuuguuucuuguucccccuuccguugaacaaaagaccagaguuuucaguguccccaauauaccucugaaagaccucucaaacucucgugucccugugccuauacagggcauguuuauguccccagauguuaaucagucaguccaguuucaaaacggacgcugccaaauugauggucaacuccagggcaccaccccagucucgcucagccaacucugcaagauuagggguaaaacuucaagcaaugcuagggugcucaacuuaagugagguagaugguacaccuuucaucccucuugaaucaccagcgccaguagguuuuccugacuuaggaggcugugacuggcacguaaauuucacuuuccagacucaagaucgggacccaucucaaagugugaccuuugcaaccaaugaugccagcuuuguccccuacuuagguagugucuccccucacaauggggaagguuuucaagcaggcgacaucauagguagccuuggguggauuucagccccgucugauaauucacaauuuaauguuugggcaauaccaaaguauggaucuagucucccagaugucacccaucuugcuccugcuguguuccccccaggcuuuggggaggugauccuauauuucuacucuaccuucccagguucuggacaacccagucaacuucaagucccauguuuguugccucaggaguucaucacccauuucuguaacgaacaggcucccaucgcuggggaggcugcccuccuccacuacguggacccugacacggggcggaacuugggggaauucaaacucuauccugauggguuuaugaccugugucccuaauaguguuagcaguggcccucaaacccuuccuauuaauggagucuuugucuuuguuucauggguguccagauucuaucaacucaagccugugggaacggccucagcggcuagaaggcuuggauugcggcguauauaa

SEQ ID NO: 5867 - RNA, 1611 nt, Artificial Sequence
  capsid__Norovirus__ACY00623
augaagauggcgucgaaugacgcuacuccaucugaugauggugcagccggccucguaccagggaucaacagugagguuauggcucuugaacccgucgcuggggccuccauugcagcccccguagucggccaacagaauauaauugaucccuggauuagaaauaauuuuguacaagccccugcuggugaauucacaguuuccccuagaaacucuccuggagaacuucuacuugauuuggaauuggguccugaacuuaaucccuaucuugcacacuuggccaggauguacaaugggcaugcaggaggaauggaagugcagauaguacuggcugggaaugcguucacagcuggugaaauccuauuugcugccaucccgccuagcuuccccuaugaaaauuugucacccgcucaauugacuaugugcccccaugugauaguugaugugagacaauuagaaccagugcuucugccaaugccagauauaagaaauguuuucuaucacuauaaccagaacaauagucccaaacuuaggcuuguagcuaugcuuuauacuccucugagggcuaacaacucaggugaugacguguucacggugucuugccgcguuuuaacacguccuucuccagauuuccaguucaccuuucuggucccaccuacaguugagucuaaaacuaagaauuucacccuucccguucuuagagucucagagaugacaaauucaagguuccccguuguuuuggaccaaauguauacaagcaggaaugaaaacaucauaguccaaccccaaaacggcaggugcacgacugacggugagcugcuuggcacuaccaucuugcagucugugucuauuugcaauuuuaaaggaacaaugcaggcaaagcugaaugaagaaccacgauaccaguuacaacucaccaacuuggaugggucacccauagauccaacagaugauaugccugccccucuuggcacaccagacuuccaggccauguuauauggcguugcaagccaacgcucuuccacagacaaugccaccagggcacaugaugcacagauugacacugcgggugauacauucgccccgaaaauuggccagguucguuuuaaaucaagcucuaaugauuuugaccuacaugacccuacaaaauucacaccuauuggugucaauguggaugaucagcacccuuuuagacaguggucccuaccaaacuacgguggucaccuugcccugaacaaucauuuagcccccgcugugacaccacucuuuccuggcgagcagauuuuguucuucaggucauacauuccaagcgccgggggccacacagacggugcuauggacugcuugcugccccaagaguggguagagcacuucuaccaggaagcugccccuucccaaucugacaucgcacugguaagguucaucaacccugacacaggaagagugcucuuugaagcuaaauugcauaaacaagguuuccucacaauugcagcaucuggagaucacccuauugugaugcccacuaaugguuacuuuagguuugaagcuugggucaacccuuucuauacucucgcccccgugggaacugggucugggcgcaggaggauucaauaa

SEQ ID NO: 5868 - RNA, 1647 nt, Artificial Sequence
  capsid__Norovirus__ACY00629
augaagauggcgucgauugacgccgcuccaucuaaugauggugccgccggccucgucccagagaucaacaaugaggcaauggcgcuagauccaguggcgggugcagcgauagcagcaccccucacuggccagcaaaauauaauugaucccuggauuaugaauaauuuugugcaagcaccugguggugaguuuacaguguccccuagaaauuccccuggugaagugcuccucaauuuggaauugggcccagaaauaaaucccuauuuggcccaucuugcuagaauguauaaugguuuugcagguggguuugaagugcagguaguccuagcuggaaaugcguuuacagcaggaaagauaaucuuugcagcuauacccccuaauuucccaauugacaaucuaagcgcagcacagaucacaauguguccacaugugauuguggacgucagacaguuggaaccggucaaccucccgaugccugauguucgcaauaacuucuuccauuacaaccaagggucugauucgaaauugcgcuuaguugcaaugcuguacacaccucucagggcaaauaauucuggggaugaugucuuuacugugucuuguagagugcugacuaggccuagcccugacuuuucauuuaauuuccuugugccacccacuguggagucaaagacaaaacccuucacccucccuauucugacuaucucugagaugucuaauucuagguuuccagugccgauugauucacugcacacuagcccaacugagaauauuguuguccaaugccaaaauggacgcgucacucuugauggugaguugaugggcaccacccaacucuuaccuagucaaaucugugcuuuuaggggcgugcucaccagaucaacaagcagggccagugaccaggccgacacagcaaccccuagauuguuuaauuauuauuggcacauacaauuggauaaucuaaaugggacuccuuaugauccugcagaagacauaccaggcccccuggggacaccagauuuccggggcaaagucuuuggcguggccagccagagaaaucccgacagcacaacuagagcacaugaagcaaagguggacacaacagcuggucguuucaccccaaaacuaggcucauuagagauauccacugaaucugaugacuuugaucaaaaccaaccaacaagguucaccccaguuggcauugggguugaccacgaggcagauuuucaacaauggucuuugcccgacuauucuggucaguucacccacaacaugaacuuagccccagcuguugcucccaacuucccuggugagcagcuccuuuucuuccgcucacaguuaccaucuucuggugggcgauccaaugggauucuagacugccuggucccccaagaauggguucagcacuucuaccaagaaucggcccccgcccaaacccaaguggcccuggucagauaugucaacccagacacugguagaguguuguuugaggccaagcugcacaaauuagguuucaugacuauagcuaagaauggugacucuccaauaacuguccccccaaauggauacuuuagguuugaaucuugggugaacccauuuuauacacuuguccccaugggaacugggaaugggcguagaaggauucaauaa

SEQ ID NO: 5869 - RNA, 1614 nt, Artificial Sequence
  capsid__Norovirus__ACY00632
auggcgucgaaugacgccgcuccaucuaacgauggugcuacaggucucguaccagagaucaacacugagaccuugccucucgagcccguggccggagcggcaauugcugccccuguuacgggccaaaauaauauaauugaucccuggauuagaaauaauuuugugcaggcgccuaauggugaguuuacagucuccccuagaaauuccccuggugaaauuuuaaugaacuuggaguuagggccagaucuuaauccauauuuggcucaccuuucaagaauguacaaugguuaugcuggagguguagaagugcaagugcuccuagcugggaaugcguucacggcaggaaagauccuuuuugcagcaguccccccaaauuuccccguugauaugcucaguccugcucaaaucacaaugcuuccccauuuaauuguagaugucagaacuuuggagcccauuaugaucccucugcccgauguuaggaauguuuucuaucacuuuaauaaccagccugccccaagaaugagauugguugccaugcucuacaccccuuuaagauccaauggguccggugaugacguauucaccgucuccugcaggguguuaaccagaccuacuccggacuuugaguuuacauacuuagucccccccucgguagaguccaaaaccaaaccuuucacccuacccauccuaacaauuggagaguugacaaacucuagauuuccagccccgaucgaucaguuguacacuucacccaacgcugauauaguuguccaaccccaaaauggccggugcacacuggauggugagcuacaagguacaacacaacuuuugacaacagcaauaugcucauacaggggcaugacaucaaaccccacuagugacuacugggaugaucaccuccugcaccugguccaccccaauggggcaacauaugacccgaccgaggacgugccagcuccuuuuggcacgcaggacuuucggggcauuuuguaugggauguugacucaaaacccccgaaccuccggggacgaagccgccaacucccaugggaucuacaucucauccaccagugaaaaguucacuccaaaauuggguacaauuggcuuacaccaagugcaagggcgacauagccagcaccaacagucaaaauucacaccaguagggauagcagugaauggcaacacuccuuucagacagugggaacucccaaacuacucuggugcccucacccucaacacaaaccuugcaccagcgguugggcccaacuucccuggggagcaaauccuuuucuucaggucaaauguuccaaguguucaagguggccaaccuauagagauugauugccugaucccacaagaaugggucucccauuuuuaucaagaaucagccccuucucagagugauguggccuuggucagguaugucaacccugacacagggcgcacaaucuuugaggccaaauugcauaggcagggauuuaucaccauagcggccacuggaagcaaccccguggucgugccucccaauggguauuucagauuugauuccugggucaaccaguuuuaugcacucgcccccaugggaacugggaaugggcgcagaagaguucaguaa

SEQ ID NO: 5870 - RNA, 1617 nt, Artificial Sequence
  capsid__Norovirus__ACY00635
augaagauggcgucgaaugacgcugcuccaucuaaugauggugccgccggccucguaccagagaucaacaaugaggucauggcauuggaaccaguagcugggggagcuaucgcagccccgcuuacuggacaaacaaauguaauugaucccuggauaagaacuaauuuuguacaagccccaaauggugaguucaccaucucucccagaaauuccccaggagaaguuuuauugaacauggaauugggcccugaguuaaaccccuucuuaggacauuuaucuagaauguauaauggcuaugcuggugggauugaaguccaaguucugauggcgggaaacgccuucacggcagguaaggucaucuuugcagcuguuccaccccauuucccuguugaaaauuugaguccuccacaagugacuauguucccucauguaauuguagauguuaggaccuuggaaccaauccuguugccccuucccgaugugagaaaccaauucuuucacuacagccagguggaugaacccaagaugcgguugguggccaugcucuacacaccgcugagaucuaacggguccgcagaagacgucuucacagugucuugcagaguguuaaccaggccaucaccagauuuugaauucaauuauuuggugccaccaacuguagaaucaagaaccaagccuuucacuguacccauccuaacuauuggggaaaugucaaauucacgcuucccugccccuauagaugugaucuauacaagucccaaugauaaucagaaugugcagccacaaaauggcagaugcacccuagauggggaacugcaaggcaccacccaacuggucccaucaggugugugugcguucaggggcagaaucacgagccacgagggaucagagcaaaaccaguggcacaugcaacugaccaaccucaaugggacaccauuugacccaacagaagacauccccgcaccccuugguaccccugacuucaaaggagaaauauuuggauucauaucacaaagaaaugcacaaaaugauccaggacaaagccaaccagccaacagggcacacgaugcggugguaucuacuagggcaccuaaauucacuccaaaacuggggucagugaugauuggcacaugggugaauucugacauugagaaccaacccucaaaauucaccccaguugggcuaaauagcagugaaaauuucaagcagugggaacuaccagauuacucaggagugcuaacccuuaacaugggauuggcacccguuguccacccaaccuaccccggugagcaaauccuauucuuuaggucauauaucccacuaaaagguggucacggcaaccccgccauagacugccuccuuccccaggaguggauccagcacuucuaucaggagucugcgcccucccaaacugauguugccuuacuuaaucccgauacaggacgaguccuguucgaggccaaauugcacagacaaggauacaucaccauugcaaaaucaggggauggaccaauuguugugcccccaaauggauauuucagguuugauucuugggugaaccaguuuuacucucuugcccccaugggaaacggaaaugggcguagaaggguucaauaa

SEQ ID NO: 5871 - RNA, 1632 nt, Artificial Sequence
  capsid__Norovirus__ACY00638
augaugauggcgucuaaggacgccccaacaaacauggauggcaccaguggugccggucagcugguuccagagguuaguacagcugaaccuauaucaauggaaccuguagcuggugcugccacagcagcagcaacugcaggucaaguuaauaugauugaccccuggauuaugaguaauuauguucaagccccucaaggagaguucacaauuuccccuaacaauacccccggagacauauuguuugauuuacaauuagguccccaucuaaacccguuucuaucacaccuggcccagauguacaauggguggguuggcaauaugaaaguuagggugcugcuugcugguaaugcauuuacagcaggcaaaauaauaaucaguugugucccuccagguuuugcagcccagaauguuucaauagcccaagcuacuauguucccccauguuauugcagaugugcgagugcuugaaccaauugaagucccacuagaggaugugaggaaugugcuuuuccacaacaaugauuccaccccaacuaugagauugauuuguauguuguacaccccucuccgugcuagugguaguucuucuggcacugauccauuuguuauagcuggucggguccucaccuguccuaguccugacuucaacuucuuauuccuuguccccccuaacguugaacagaaaaccaagccauucagugugcccgaucucccccuuaauguucucucaaacucuaggguccccuccuugauaaaguccaugauggucucccaagaucauggacagaugguacaauuccaaaauggcaggguuacauuagauggacagcuccaaggcaccacccccacuucagcuagccagcucugcaaaauucgagggacggucuaccaugcaacugguggacaagggcuuaauuuaacugaaauugaugggacccccuaccaugcauuugagagcccugccccaauuggcuuccccgauuuaggugagugugauuggcacauuaaugcauccccugccaaugccuucacagaugguagcauuauacacagaauugauguaguucaggauccuacuuuugccccccaucuaggcacuauccacuauacuaaugcuaauuaugaugcuaauguuagccugaucuguucacuugaauggcuuuccccaccaagugguggugcucuaaaagcaaacccaugggccauuccucgguauggcucaacccugacugaggccgcccaauuggccccaccaauauaccccccuggcuuuggugaggcaauuguuuucuuuaugucugauuucccuauagcuaaugguucagauggucugaguguccccugcacuauaccacaagaguuugugacucacuuuguuaaugaacaagcaccaacccguggggaagcugcccuccuucauuauguugacccugacacacaccgcaaucuaggugaguuuaaauuauauccugaaggguucaugaccugcguaccaaauucuagugguagugguccccaaacacugcccaucaauggggucuucacuuucaucucuuggguuucccguuucuaccaacuaaagccugugggaacgaccggaccgguucguaggcucggaauuaggagaucauaa

SEQ ID NO: 5872 - RNA, 1635 nt, Artificial Sequence
  capsid__Norovirus__ACY00641
augaugauggcgucuaaggacgccccaacaaacauggauggcaccaguggugccggucagcugguaccagaggcaaauacagcugaaccuauaucaauggacccaguggcuggagccgcaacagcgguugcaacugcuggacaaauuaauaugauugaccccuggauaaugaguaauuuugugcaagccccacaaggggaauucacugucucaccuaacaacaccccuggagauguucuguuugauuuacaauugggaccucaacuaaauccauuccucgcucaucuagcccagauguauaauggcuggguaggcaauaugcgugugaaggugcugcuugcuggcaacgcuuuuacugcagggaaaauaauaauuagcugcauacccccagguuuuaccucccaaaauauuucuauugcccaaaugacaauguuuccucauguuaucgcugacgugaggguuuuggaaccuauagaaauaccccuugaggaugugaggaaugugcuguuucacaccaaugacaaccgcccaacaaugaggcuugugugcauguuguauacucccuugcgagccaauggcaguucuucuggcacggacccuuuugucauagcuggccggguucucaccugcccagauucaaauuuuaguuuccuauuuuuaguacccccuaauguagaacaaaagaccagaccuuuuaguguucccaauauaccucugaauacauugucaaauucaagggugccaucauugauuaagucuaugaccaucucuagagaucagaaucaaauaauucaauuucaaaaugguaggguuacauuggauggucagcuacagggcaccacacccacaucagugagccaguuguguaaaauuagaggcacuacauaccacgcaacuggagguagugggauaaauuuaacagaguugaauggugaaccauaccaugccuuugaaagccccgccccgauaggguuuccagaucuuggugguugcgauuggcaucucacagcaacccccacgcaggcuuucaacgauggagcaaagguugugcgccugucagucacccagggcgcagccuuugcaccacacuuggguaccauacauuacaccacuacugacacugauuacaaccccaacacuagcauaauuugcacacuagauuggcugucccaaacuacuggucagaguaauguugacccuuggcagauaccaacuuaugggucgacuuuaacugaagccgcucaguuggcgccuccuaucuuucccccuggguuuggagaaacauugguuuucuuucuaucagacuucccuauuuccaauggcaagaacggacucaguguaccgugcacucucccacaggaauuugucacccauuuugugaaugaacaggccccaaucagaggagaggccgcccucuugcauuaugcugacccugacacucaccguaaucuuggagaguuuaaauuguauccagaagguuuuaugaccuguguuccuaauacuagugguggugguccccaaacuuugccuaucaauggagucuuugucuuuguuucuugggucucucgcuuuuaccaguugaagccugugggaacggccggugcggcucguaggcuuggaaucaggaggucauaa

SEQ ID NO: 5873 - RNA, 1635 nt, Artificial Sequence
  capsid__Norovirus__ACY00645
augaugauggcgucuaaggacgccccaacaaacauggauggcaccaguggugccggucagcugguaccagaggcaaauacagcugaaccuauaucaauggacccaguggcuggagccgcaacagcgguugcaacugcuggacaaauuaauaugauugaccccuggauaaugaguaauuuugugcaagccccacaaggggaauucacugucucaccuaacaacaccccuggagauguucuguuugauuuacaauugggaccucaacuaaauccauuccucgcucaucuagcccagauguauaauggcuggguaggcaauaugcgugugaaggugcugcuugcuggcaacgcuuuuacugcagggaaaauaauaauuagcugcauacccccagguuuuaccucccaaaauauuucuauugcccaaaugacaauguuuccucauguuaucgcugacgugaggguuuuggaaccuauagaaauaccccuugaggaugugaggaaugugcuguuucacaccaaugacaaccgcccaacaaugaggcuugugugcauguuguauacucccuugcgagccaauggcaguucuucuggcacggacccuuuugucauagcuggccggguucucaccugcccagauucaaauuuuaguuuccuauuuuuaguacccccuaauguagaacaaaagacuagaccuuuuaguguucccaauauaccucugaauacauugucaaauucaagggugccaucauugauuaagucuaugaccaucucuagagaucagaaucaaauaauucaauuucaaaaugguaggguuacauuggauggucagcuacagggcaccacacccacaucagugagccaguuguguaaaauuagaggcacuacauaccacgcaacuggagguagugggauaaauuuaacagaguugaauggugaaccauaccaugccuuugaaagccccgccccgauaggguuuccagaucuuggugguugcgauuggcaucucacagcaacccccacgcaggcuuucaacgauggagcaaagguugugcgccugucagucacccagggcgcagccuuugcaccacacuuggguaccauacauuacaccacuacugacacugauuacaaccccaacacuagcauaauuugcacacuagauuggcugucccaaacuacuggucagaguaauguugacccuuggcagauaccaacuuaugggucggcuuuaacugaagccgcucaguuggcgccuccuaucuuucccccuggguuuggagaaacauugguuuucuuucuaucagacuucccuauuuccaauggcaagaacggacucaguguaccgugcacucuuccacaggaauuugucacccauuuugugaaugaacaggccccaaucagaggagaggccgcccucuugcauuauguugacccugacacucaccguaaucuuggagaguuuaaauuguauccagaagguuuuaugaccuguguuccuaauacuagugguggugguccccaaacuuugccuaucaauggagucuuugucuuuguuucuugggucucucgcuuuuaccaguugaagccugugggaacggccggugcggcucguaggcuuggaaucaggaggucauaa

SEQ ID NO: 5874 - RNA, 1635 nt, Artificial Sequence
  capsid__Norovirus__ACY00647
augaugauggcgucuaaggacgccccaacaaacauggauggcaccaguggugccggccagcugguaccagaggcaaauacagcugagccuauuucaauggaaccaguagcuggggcugcgacagcagccgcaacugcuggacaaguaaauaugauugaccccuggauaaugaauaauuauguacaagccccucaaggagaguucaccauuucgcccaacaacacuccuggugacauuuuauuugaccuacaauuggguccacaccucaacccuuucuugucccauuuagcucaaauguacaaugguugggucggaaacaugaaagugaaggugcuuuuggcaggcaaugccuuuacagcugggaagauuauaauuaguuguauacccccuggcuuugccgcacaaaauauuuccauagcucaagcuacaauguucccccaugucauugcagaugucagagugcuugaaccuauagagguuccccuugaagaugucagaaaugugcucuuccauaauaaugauaauuccccuacuaugagauuggucugcauguuauauacaccucuuagggcuagugguagcucaucagguacugacccauuugucauugcaggaaggguccugacuugcccgagcccggauuuuagcuucuuauuucuuguccccccgaauguagaacagaaaaccaaacccuucucugugcccaacuugccacuaaauacacucucuaacucaaggguuccuucacuuaucaaugcuaugaugauuucuagagaccaugggcagauggugcaguuccagaauggcagggucacgcuugauggucaguugcaggguacaaccccuacuucacugagccagcuauguaagauuagagggaaagucuuccaugcuaguggaggcaauggucugaaccucacugaauuggauggcucugcuuaucaugccuuugaaaguccugcuccaauuggguucccagacauuggugagugugauuggcacaugaacgccacagcuacuagcaauuucacuggguccaaugaugaguaucaaauucuugucaaacaagagucaacauuugccccccaccuuggucaugugcaggcugacagccuaucggcagacgcuaacaccgaccuuauggugucuuugaguuggauauccccuguuucagaccaacacaggcgugacguggacccaugggucauaccacguuaugguucuucccucacugaagcugcccaauuggccccgcccauuuacccuccuggauuuggugaagcuauaguguucuuuaugucugauuuuccaguggugucggguguuaaugguaugaggauuccaugcacacuaccucaggaauauguggcucauuuuguaaacgagcaggcucccacucgaggugaggcagcucuuuugcauuauguugauccugacacucacagaaaccuaggugaguuuaaaauguauccugagggcuuuaugaccugugugcccaauuccaguggaucugguccucagaccuuaccuauuaauggaguccuuacuuuugucucuuggguuucucguuucuaucaauuaaagccugugggaacugcugguccagcacguaggcuuggcaucagaagaucauaa

SEQ ID NO: 5875 - RNA, 1668 nt, Artificial Sequence
  capsid__Norovirus__ACY00650
augaggauggcgucgagugacgcgcccguuucuggcaccgauggugcggcaggacucguuccagagagucaacaagaagucuugccuuuagagcccgucgcgggaguucagcuggcugcucccguagcagggcaaaguaauauaauugaccccuggauuagaaugaauuuugugcaagccccggccggugaguucacuguguccccucgggacgcaccgggugagguacuuauugauuuagaauuaggaccagaauuaaaucccuaucuuaaucaccuugcaagaauguauaauggguauguaggaggaauggagguggaaguuguccuugccgggaaugcguucacggcggguaagaucuuauucgcagcugugccccccagcuucccaacccauggcaucucugcagcacaggcaacuauguugccacaugugauuguggaugucaggcagcuggagccuguucggcucccucucccugaugucaggaaugugauguuccauuucugucaagagaauaaggagccgcgcaugagaauuguggcaauauuguacaccccccuccgugcuaacggugcgggugacgauguuuucacugucucaugucgugugcuaacaagacccucaccagauuuugauuuuauuuucuuaguccuccccucuguagagaguaaguugaaacaguuuacccucccaaaucugcagccaaaugagaugaccaauucgagauuccccacugguauuauacagcuuuacaccaguccaaacaccaauuugguuguccaguuccaaaauggcaggugucuacuugauggcacacuucuugguaccaccccugucagagcugcugacaucugcaguuuuagaggggucacaucaacugaaguugaugcaacugacagucccagaguggcagggucacauagaauuauggugcagcuuaaggagccagauggagaggaguuuucacccacaggucccaacccugccccuguuggcacuccagacuuucaagcagccauauuuggcacccuuagucaaagaaauacuggcggggcugggcagaacuccaacagagcccgcuucgcauacuucuauacuagaaacccuacauucgcaccaggcauagggacaguuguauuuucuuuugacaccacugauuuucagaaucgccaaccuaccaaauucucuccuucugguguguuugaugaugacucuucugaaccuuucaaucaauuuucucuaccauauuauaauggaucacucggugcaguggaugcugggaaacuggcuccgccuguggcacccaauuauccaggugagcagauucuuuauuucagagggaauauacccuucaaagguggguauggagagggugaaauugauagcuugcuuccccaggaauggaucacccacuuuuaugcagagcaggcccccacacaaggugacgcagcccugcugcgcuacuacaacccugacacuggcagaguccucuuugagugcaaacuccaccgcgagggauucaucacaaucaauuacacaggauccaaugcucuugcuguaccagucaauggagucuucagguuugagggcuggguuaacaaauucuacacacugacccccaugggaaauggcaauggccgcagggguagaagaagggaguuauaa

SEQ ID NO: 5876 - RNA, 1617 nt, Artificial Sequence
  capsid__Norovirus__ACY00656
auggcgucgaaugacgccgcuccaucuaaugauggugcagccggucucguaccagaggucaacaacgagacaauggcacuugagccaguugcgggagcuucaaucgccgccccucuaacuggucaaaacaauguaauagaccccuggauuagauuaaauuuuguacaagccccuaacggugaguucacgguuuccccccgaaacucgccuggugaaauuuuguuaaauuuggaguuagggccugaauugaauccauauuuagcccauuuaucaagaauguauaaugguuaugcaggugggguugaggugcaggugcugcuggcuggaaaugcguuuacagcgggcaaauugguauucgcagcaauccccccccauuucccaguagauaauuugagcccuggucagauuacuauguuuccccaugugauuauugauguuaggacacuugaaccuguuuuauuaccauuaccugauguuaggaauaauuucuuccauuauaaucagcagagugaucagcguaugagacuuguugcuaugcuuuauacuccucuuagaucuaaugguucgggugaugaugucuucacugugucaugcaggguuuuaaccaggccauccccugauuuugauuuuaacuauuugguucccccaacaguugaaucuaaaacuaaacccuucucaguuccagugcugacccucaaugagcugaccaacucucgcuuucccgucccgauugaugccauguacaccagcccuaacgauucaauugugguccaaccucagaaugggagggcaaccauagauggugaguugcuuggcaccacucaacucauccccagugguaucugcucauuuagagggaaaauuacaacacauuuggcagaugauaggcacuuguggaauauccaagucuccaacuugaauggcacuccguuugacccaacggacgacgugccugcaccauugggcaugccagacuuuucugggcaaauauuuggggugguuagccaaagggacacaggcaccaaccccgcaaacagggcucaugaugcuguccuugcaaccuacagugcuaaauauacuccuaagcucggaucaguccaaauuggaacuugggacaccgaggauuuacuugaaagacagccuguuaaauuuacacccguuggucucaaugaaauuggacaagacaagcacuuugaccaaugggucuugccaaauuauucuggugcccuaggacucaauaugcaccuggcuccugcuguguccccacucuucccaggggagaggcugcuguucuuuagaucguauauuccucuaaaagguggccauggggacccauuuauugauugucuugugccucaagaguggauacaacauuuuuaucaagagucagccccagcgcaaucuucgguggcucugcugagguaugugaauccagacacaggucgcacccuguuugaagccaaauuacacaagggaggguuuaucaccgucucuaguacggaaaacaggccugugauuguccccccgaauggcuacuuuagguuugauucuuggguuaaccaauucuauucauuagcccccaugggaacuggcaaugggcgcagaaggaugcaguaa

SEQ ID NO: 5877 - RNA, 1623 nt, Artificial Sequence
  capsid__Norovirus__ADK47170
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguucacaguguccccuagaaacgcuccaggugaaauacuauggagcgcgcccuuaggcccugauuugaaucccuaccuuucccauuuguccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccacauaauaguagaugucaggcaauuggaaccuguguugauucccuuacccgauguuagaaauaauuucuaccauuauaaucaaucaaaugaccccaccaucaaauugauagcaauguuguacacaccacuuagggcuaauaaugccggggaugacgucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggucccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagcagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucauaaugugcaccuggcccccgcuguagcccccacuuucccgggcgagcagcuccucuucuuuagaucuacuaugcccggaugcagcggguaccccaacauggauuuggacugucugcucccccaggaaugggugcaguauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 5878 - RNA, 1644 nt, Artificial Sequence
  capsid__Norovirus__ADR30514
augaagauggcgucgaaugacgcugcuccaucgaaugauggugcugccgaccucguaccagaggccaacaaugagguuauggcacuugaaccgguggugggagccucaaucgcagcuccugucgucggccaacaaaacauaauugaccccuggauuagagaaaauuuuguccaagcaccacagggcgaguucaccgucucaccgaggaacucgccuggugagaugcuauuaaaucuugaauugggcccagaacucaacccuuaccuaagucaccugucccguauguauaauggguaugcugguggcaugcagguucaggugguccuagcugggaaugcguucacagcugggaaaaucaucuuugccgccguaccaccacauuuucccguagaaaacauuagugcagcucaaauaacuaugugcccccauguaauuguugaugugagacaacuugaaccaguacuucugccccuuccugacauaaggaacagguucuuucauuacaaucaggagaacaccccccggaugagacuuguggcuaugcucuacaccccccugagggccaacucuggugaagauguguuuacugucucuuguagggucuugacccguccugccccugauuuugaauuuacuuucuugguaccaccaacuguugaaucaaagacuaaaccuuucacacugcccauacuaacucuuggugagcuaucuaacuccagauucccagccccaauagauauguuguacacugacccaaaugagggaauugugguccaaccacaaaaugguaggugcacucuugauggcacucugcaaggcaccacacaacugguccccacccaaauuugugcuuucaggggcacacuaauuggccaaacaucaagaucuucagacucaaccgacucagccccucggagaagggaucacccacuccaugugcaauuaaagaaccuugauggcacgcaguacgacccaacugaugaagugccagcaguccuuggugccauugacuucaaggggacugucuuugggguggccagucagagagacgugucagggcaacaagugggagcaacucgagcccaugaagugcacaucaacacaaccgauccuagguauacaccaaaacugggauccauucucaugcacucagagucggacgacuuugugacuggacagccgguccgcuucacacccauaggaaugggugacaacgacuggcaccagugggagcugccugacuacucuggacaccuaacccugaacaugagccucgccccagcagucgcuccugcuuuuccgggcgagaggauucuuuucuucaggucaauaguuccgucugcugguggcuaugggucuggacaaauagauugccucauaccacaggaguggguucagcauuucuaccaggaagcugcaccaucccaaucugccguggcacucauuagguaugucaauccugacacaggcagaaacaucuuugaggcuaaauugcacagggaagguuucaucaccguggcaaauucugguaacaaccccauuguuguccccccuaauggguauuuuagguuugaggcuugggugaaucaauuuuacacuuugacccccaugggaacuggucaggggcguaggaggaaucaauaa

SEQ ID NO: 5879 - RNA, 1623 nt, Artificial Sequence
  capsid__Norovirus__ADR78255
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggaucagaaauaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccacauaauaguagauguuaggcaauuggaaccuguguugauccccuuacccgauguuaggaauaauuucuaucacuacaaucaaucaaaugaccccaccaucaaauugauagcaauguuguauacaccacuuagggcuaauaaugcuggggacgaugucuucacaguuucuugucggguucucacgagaccaucccccgauuuugauuucauauuuuuaguaccacccacaguugagucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgacugacggcgugcuccuagguaccacucaacugucuccugucaacaucugcaccuucagaggggaugucacccauauugcagguagucguaacuacacaaugaauuuggcuacucaaaauuggaacaguuaugacccaacagaagaaaucccagccccucuaggaacuccagauuucguggggaagauucaaggugugcucacccaaaccacaagggcagauggcucgacccgcggccacaaagcuacaguguacacugggagcgccgauuuuucuccaaaacugggcagaguucaauuugccacugacacagacaaugauuuugaugcuaaccaaaacacaaaguucaccccagucggugucauccaggaugguaauacugcccaccgaaaugaaccccaacaaugggugcucccaaguuacucaggcagaaauagucacaaugugcaccuggcccccgcuguagcccccacuuuuccgggugagcaacuucucuucuucagauccacuaugcccggaugcagcggguaccccaacauggauuuggacugccugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcccacaccggccaacaugauuugguuaucccccccaaugguuacuuuagauuugauuccugggucaaccaguucuacacacuugcccccaugggaaauggaacggggcguagacgugcauuauaa

SEQ ID NO: 5880 - RNA, 1623 nt, Artificial Sequence
  capsid__Norovirus__ADR78259
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuguccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagaugucaggcaauuggaaccuguguugauucccuuacccgauguuagaaauaauuucuaccauuauaaucaaucaaaugaccccaccaucaaauugauagcaauguuguacacaccacuuagggcuaauaaugccggggaugaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggucccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccguggccacaaagcuacaguguacacugggagcgccgauuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuauucaggcagaaacauucauaaugugcaccuggcccccgcuguagcccccacuuucccgggcgagcagcuccucuucuucagaucuacuaugcccggaugcagcggguaccccaacauggacuuggacugucugcucccccaggaaugggugcaguauuucuaccaggaggcagccccagcacaaucugauguggcucuguuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 5881 - RNA, 1623 nt, Artificial Sequence
  capsid__Norovirus__ADR78262
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuguccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagaugucaggcaauuggaaccuguguugauucccuuacccgauguuagaaauaauuucuaccauuauaaucaaucaaaugaccccaccaucaaauugauagcaauguuguacacaccacuuagggcuaauaaugccggggaugaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggucccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccguggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuauucaggcagaaacacucauaaugugcaccuggcccccgcuguagcccccacuuucccgggcgagcagcuccucuucuucagaucuacuaugcccggaugcagcggguaccccaacauggacuuggacugucugcucccccaggaaugggugcaguauuucuaccaggaggcagccccagcacaaucugauguggcucuguuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 5882 - RNA, 1623 nt, Artificial Sequence
  capsid__Norovirus__ADR78266
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuguccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagaugucaggcaauuggaaccuguguugauucccuuacccgauguuagaaauaauuucuaccauuauaaucaaucaaaugaccccaccaucaaauugauagcaauguuguacacaccacuuagggcuaauaaugccggggaugaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggucccaguagugccuuuguuguucaaccacaaaacggcaggugcacgacugauggcgugcuccuagguacuacccaacugucuccugucaacaucugcaccuucagaggggaugucacccauauuucaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccguggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguagcaccaccccccgaaaugaaccccaacaaugggugcucccaaguuauucaggcagaaacauucauaaugugcaccuggcccccgcuguagcccccacuuucccgggcgagcagcuccucuucuucagaucuacuaugcccggaugcagcggguaccccaacauggacuuggacugucugcucccccaggaaugggugcaguauuucuaccaggaggcagccccagcacaaucugauguggcucuguuaagauuugugaauccggacacagguaggguuuuguuugaguguaagcuccauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 5883 - RNA, 1623 nt, Artificial Sequence
  capsid__Norovirus__ADR78268
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuguccagaauguacaaugguuaugcaggugguuuugaagugcagguaauccucgcggggaaugcguucaccgccgggaaaaucauauuugcagcagucccaccaaauuucccaacugaagguuugagccccagccaggucacuauguucccccacauaauaguagaugucaggcaauuggaaccuguguugauucccuuacccgauguuagaaauaauuucuaccauuauaaucaaucaaaugaccccaccaucaaauugauagcaauguuguacacaccacuuagggcuaauaaugccggggaugaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggucccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauccaaggugugcucacccaaaccacaaggacaaauggcucgacccguggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuauucaggcagaaacauucauaaugugcaccuggcccccgcuguagcccccacuuucccgggcgagcagcuccucuucuucagaucuacuaugcccggaugcagcggguaccccaacauggacuuggacugucugcucccccaggaaugggugcaguauuucuaccaggaggcagccccagcacaaucugauguggcucuguuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 5884 - RNA, 1569 nt, Artificial Sequence
  capsid__Norovirus__AFQ00093
augaagaugacugacagagacauuguugauucugcuccggcgcucggacaaguccucccucccgagguugaggcguccguccccguugagccaacagcuggcgcccccgucgccgcuuccacugcugggcggguuaauccaauugauccuuggauuuuugcuaauuuugugcaagccccccagggagaguuuacuauauccccaaauaauaacccuggugagauuuuauuugaauuggaacuuggcccugaucugaauccuuauuuggcccaccuucgucgcauguauaauggguggaccggauccaugcgcgugcgaguccuccuggcagggaacgccuuuucggcgggcaagguggugguguuuuguguccccccuggauuugacacuucuuaucugacccccucccaggccacccaguuuccccaugugcugaucgaugugcgcgcuccagagccugucgauaugccccuugaagauguucguaacauccuuuuucaucaggggcccgauucacgcaugaggcugauggggaugcuguauaccccccugcgcgccaauuccggcgcggacccuuuuguugucaccggucguguccucacuugucccagccccaauuuuuccuucuucuuucugguuccccccaccguugaggagagggagccccccuucacuuugccaaauuugccugucaauagucuuucacauucccgggucauggaaccgauagcccaaaugaugagcucccguagcuuuccagcuucaguucaguuccagaauggccgcugcacccuuucuggcgaccuucuggguacgacuccaucauccccugccgaucugggcgcuuucgugggccugauugccgaaccugguucccgugucguugaauugucccagcccaaccaggaggauuuucaugcugggucugccccagcccccuuuggcuuuccagauuuuuccgaauguucugugacuuuugugguggcuagugcgacaaccgucggcgaacgcacugugaaugcccgcaacccccaaaauuuuacucccgcccucggacauaucacuuuugaugaggaggccccugccgacuuguuucgggcucgcuuccggaaucucugggagccaaccgagcacuccuucuggaggaucccagauuaucgagcugaugugcuugguucugauuuugccccuucuguuucagccccaggcguuggugaaacucuccuuuucuuuaugugcaauguuccucgccuuaauggcgcuaaucccaacccuugcccuugcuugcuuccccaggaguggauuacccauuucguuucugagcgcgccgcucuucagagcgauguggcgcuccucaauuauguuaaucccaacaccggccggguucuguuugaggccaagcuguaugcuaauggcuuucucaccgucaaccuuggcgccucggaccaggcgauccugcccguggacgggauauuuaaauuuguuucuuggguuucuuucuauuaccaguugcggcccgugggaaauauuaguguuggccgccgccuuccccgucuugauggcuucuga

SEQ ID NO: 5885 - RNA, 1629 nt, Artificial Sequence
  capsid__Norovirus__BAI52939
augaagauggcgucgaaugacgccgcuccaucuacugauggugcagccggccucgugccagaaaguaauaaugaggucauggcucuugaacccguggcuggugccgccuuggcagccccggucaccggucaaacaaauauuauagacccuuggauuagagcaaauuuuguccaggcccccaauggugaauuuacggucucuccccguaaugccccuggugaagugcuauugaaucuagaguuggguccagaauuaaauccuuaucuggcacauuuagcaagaauguacaacggguaugccggugggauggaagugcaggucauguuggcugggaacgcguucacagccggcaagcuggucuucgccgcugugccaccucacuucccgauugaaaaccuuaguccgcagcaaauuaccauguuuccucaugugauuauagauguaaggacuuuggaacccguuuuauuaccacucccugauguuagaaauaauuucuuccauuauaaucagaaagaugaucccaagaugagaaucguggccaugcuuuacaccccccuuaggucuaaugguucaggugaugauguauucacagucuccugcaggguguugacuagacccuccccugauuuugauuucacauaucuggugccaccaacaguggaaucuaaaacaaaaccauucacccucccaauucucacacuuggggaacuuuccaauucuagguuuccagcguccauagaccagauguacaccagccccaaugaaguuauaucagugcagugucaaaaugguaggugcacacuggauggggagcuccaaggaacaacacaacuccaagucaguggcauuugugcuuuuaagggagaaguaaccgcccacuugcaugacaaugaucaccuauacaauaucaccaucacaaacuugaauggguccccuuuugaucccuccgaggacaucccugccccccugggcaugccugacuuucagggaagggucuuugguaucaucucccaaagagacaggcacaauuccccuggacauaaugaaccagcaaauaggggacacgacgcuguggucccaacuuacacagcacaguacaccccaaaauugggucagauucaaauuggcacauggcagaccgacgaucucacagucagccaaccaguaaaauucaccccaguuggacucaaugauacugaacauuuuaaccaaugggugguuccuagauaugcuggugcucuaaaucuuaauacaaaucuugccccuucuguugcuccaguauuuccaggggagcgccugcucuuuuucagaucauauaucccccucaagggugguuauggaaauccagccauugauugccuauuaccacaagagugggugcaacauuucuaccaggaagcagccccuucaaugagugagguggcucuugucagaugcaucaacccggauacuggucgggcacuguucgaggccaagcuccacagagcugguuucaugacagucucaagcaacaccagugccccggugguugugccugccaacggauacuuuagauuugauucuugggugaaccaauucuauucucucgcccccaugggaacuggaaaugggcguagaaggguucaauaa

SEQ ID NO: 5886 - RNA, 1623 nt, Artificial Sequence
  capsid__Norovirus__BAI52940
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugggucccagccaggucacuauguucccccacauaauaguggauguuaggcaauuggaaccuguguugauccccuuaccugauguuaggaauaacuucuaucacuauaaucagucaaaugauucuaccauuaaauugauagcaauguuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcaggugcacgacugauggcgugcucuuaggcaccacccaacugucuccugucaacaucugcaccuucagaggggaugucacccgcauugcagguucucguaauuacacaaugaauuuggcuucucuaaauuggaacaauuaugacccaacagaagaaauuccagccccucuaggaaccccagauuucgugggaaagauccaaggagugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccugcucccccaggagugggugcagcacuucuaccaagaggcagcuccagcacaaucugauguggcgcuauugagauuugugaauccagacacggguaggguccuguuugagugcaagcuucacaaaucaggcuaugucacaguggcucacaccggccagcaugaucuggucaucccccccaaugguuauuuuagguuugauuccuggguuaaucaguucuacacacuugcccccaugggaaauggaacggggcguagacgugcuuuauaa

SEQ ID NO: 5887 - RNA, 1623 nt, Artificial Sequence
  capsid__Norovirus__BAQ20801
augaagauggcgucgagugacgccaacccauccgauggguccgcagccaaccucgucccagaggucaacaaugaggauauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuuggguccugaucuaaaucccuaccuaucccaucuggccagaauguacaaugguuaugcaggugguuuugaagugcagguaauucucgcggggaacgcguucaccgccgggaaggucauauuugcagcagucccaccaaauuuuccaacagaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguacacaccacuuagggcuaauaaugcuggggaugaugucuucacaguuucuugccgaguccucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaauggcaggugcacgacugauggcgugcuccuaggcaccacccaacugucuccugucaacaucugcaccuucagaggagaugucacccacaucacagguagucguaacuacacaaugaauuuggcuucucaaaauuggaacaauuaugacccaacagaagaaaucccagccccucuaggaaccccagauuuuguggggaagauucaaggcgugcucacccaaaccacaaggacagaugguucaacacgcggccacaaagcuacaguguauacugggagcgccaauuuuucuccaaaacuggguagaguucaauuugaaacugauacagaccaugauuuugaaguuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaacccagacacagguaggguuuuguuugaguguaagcuucauaaaucaggcuauguuacaguggcucacacuggccaacaugauuuaguuaucccccccaaugguuauuuuagguuugauuccugggucaaccaguuuuacacgcuugcccccaugggaaauggaacggggcguaggcgugcacuauaa

SEQ ID NO: 5888 - RNA, 1623 nt, Artificial Sequence
  capsid__Norovirus__BAQ20803
augaagauggcgucgagugacgccaacccauccgauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuuggguccugaucuaaaucccuaccuaucccaucuggccagaauguacaaugguuaugcaggugguuuugaagugcagguaauucucgcggggaacgcguucaccgccgggaaggucauauuugcagcagucccaccaaauuuuccaacagaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguacacaccacuuagggcuaauaacgcuggggaugaugucuucacaguuucuugccgaguccucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaauggcaggugcacgacugauggcgugcuccuaggcaccacccaacugucuccugucaacaucugcaccuucagaggagaugucacccacaucacagguagucguaacuacacaaugaauuuggcuucucaaaauuggaacaauuaugacccaacagaagaaaucccagccccucuaggaaccccagauuuuguggggaagauucaaggcgugcucacccaaaccacaaggacagaugguucaacacgcggccacaaagcuacaguguacacugggagcgccaauuuuucuccaaaacuggguagaguucaauuugaaacugauacagaccaugauuuugaaguuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaacccagacacagguaggguuuuguuugaguguaagcuucauaaaucaggcuauguuacaguggcucacacuggccaacaugauuuaguuaucccccccaaugguuauuuuagguuugauuccugggucaaccaguuuuacacgcuugcccccaugggaaauggaacggggcguaggcgugcacuauaa

SEQ ID NO: 5889 - RNA, 1623 nt, Artificial Sequence
  capsid__Norovirus__BAQ20805
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcagguggcuuugaagugcaggugauucucgcggggaaugcguucaccgccgggaaggucauauuugcagcagucccaccaaauuuuccaacugaaggcuugagccccagucagguuacuauguucccccauauaguaguagauguuaggcaacuagaaccuguguugauucccuuacccgauguuaggaauaauuuuuaucauuacaaucaaucaaaugacccuaccauuaaauugauagcaauguuguauacaccacuuagggcuaauaaugcuggggaugaugucuucacaguuucuugccgaguucuuacgagaccaucccccgauuuugauuucauauuucuagugccacccacaggugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccagcugucuccugucaacaucugcaccuucagaggagaugucacccauaccacagguagucauaacuacacaaugaauuuggcuucucaaaauuggaacaauuaugacccaacagaagaaaucccagccccucuaggaacuccagauuuuguggggaagauucaaggcaugcucacccaaaccacaaggacagauggcucaacacgcggccacaaagcuacaguguauacugggagcgccgacuuugcuccaaaacuggguagaguucaauuuggaacugacacagaccaugaucuugaagcuaaccaaaacacaaaguucaccccaguuggugucauccaagaugguagcaccacccaccgaaacgaaccccaacagugggugcucccaaguuauucaggcagaaauacuccuaaugugcauuuggcccccgcuguggcccccacuuuuccgggugagcaacuucucuucuucagauccaccaugcccggaugcagcggguaccccaacauggauuuggauugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccuggguaaaccaguuuuacacgcuugcccccaugggaaauggaacggggcguagacgugcacuauaa

SEQ ID NO: 5890 - RNA, 1647 nt, Artificial Sequence
  capsid_protein__Norovirus__AAB06271
augaagauggcgucgaaucgcgcugcuccaucuaaugauggugccgccugccucgucccagagaucaacaaugaggcaauggcgcuagagccaguggcgggugcagcgauagcagcgccccucacuggccagcaaaauauaauugaucccuggauuaugaauaauuuugugcaagcaccugguggugaguuuacagugucacccaggaauuccccuggugaagugcuucuuaauuuggaauuagguccagaaauaaauccuuauuuggcucaucuugcuagaauguacaaugguuaugcagguggauuugaagugcaagugguccuggcuggaaaugcguuuacagcagcaaaaauuaucuuugcagcuauacccccuaacuucccuauugacaaucugagcgcggcacagaucacaaugugcccgcaugugauuguggaugucaggcaguuggaaccaaucaaucuuccgaugccugauguccgcaacaauuucuuucauuauaaucaagguucugauucaagauuacgcuuaauugcaaugcuguauacaccucuuagggcaaauaauucuggagaugauguuuucacugugucuuguaggguguuaacuaggccuagcccugauuucuuauucaauuuucuugucccacccacuguggaaucaaagacaaaaccuuuuacccuccccauuuuaaccaucucugaaaugucuaauuccagguuuccggugccaauugacucucugcacaccagcccaacugagaauauaguuguccagugccaaaaugggcgcgucacucuugacggugaguugaugggcaccacccaacucuuaccgagccaaauaugugcuuucaggggcacacucacuggaucaacaagcagggccagugaccaagccgacacaccaaccccuaggcuauucaaccaucauuggcacauacaauuggauaaucuaaauggaacucccuacgacccugcagaggacauaccagcuccuuugggcacaccagacuuccggggcaaggucuuuggcguagccggccagagaaaccccgacagcacaacaagggcacaugaagcaaaaguggacacaacaucuggccgcuucaccccaaaauugggcuccuuagaaauaaccacugaaucugaugaccuugaccuaagccagccaacaaaauucaccccaguuggcauuggaguugacaauagggcagaauuucagcaaugguccuuaccugacuauuccggucaguuuacucacaacaugaacuuggccccagcugucgcccccaauuuuccuggugaacagcuacuuuucuuccgaucacagcugccauccucuggugggcggucuaacgggguucuagacugccuggucccccaggaauggguucaacacuuuuaccaagaaucagcccccgcccaaacacagguggcccugguuagguaugucaacccugacacugguagagugcuauuugaggccaagcuacacaaauuggguuuuaugacuguagcaaagaauggugacuccccaauaacugucccuccaaaugguuauuuuagauuugaaucuuggguuaaccccuuuuacacacuugcccccaugggaacuggaaacgggcguagaaggauucaauaa

SEQ ID NO: 5891 - RNA, 1620 nt, Artificial Sequence
  capsid_protein__Norovirus__AAK96218
augaagauggcgucgagugacgccaacccaucugauggguccacagccaaccucgucccagaggucaacaaugagguuauggcuuuggagcccguuguuggugccgcuauugcgggaccuguagcgggccaacagaauguaauugaccccuggauuagaaauaauuuuguacaagccccugguggagaguuuacaguguccccuacaaacgcuccgggugagauacuauggagcgcgcccuugggcccugauuugaaccccuaccuuucccauuuggccagaauguacaaugguuaugcagguggcuuugaagugcagguaauccucgcggggaacgcguucaccgccgggaaaaucauauuugcagcagucccaccaaauuuuccaacugaaggcuugagccccagccagguuacuauguucccccauauaauaguagauguuaggcaauuggaaccuguguugauccccuuaccugaugcuaggaauaauuuuuaucauuacaaucagucaaacgauucuaccauuaaauugauagcaaugcuguauacaccacucagggccaauaaugcuggggaugaugucuucacagucucuugucgaguccucacgaggccaucccccgauuuugauuucauauucuugguaccacccacagucgaaucaagaacuaaaccauucaccgucccaaucuuaacuguugaggaaauguccaauucaagauuccccauuccuuuggaaaaguuguacacgggucccagcaguguuuuuguuguccaaccacaaaauggcaggugcacgacugauggcgugcucuuaggcacuacccagcugucugcugucaacaucugcaccuucagaggggaugucacccacauugcaggcagucaugauuacacaaugaauuuggcuucucaaaauuggaacaauuaugacccaacagaagaaaucccagccccucugggaaccccagauuucgugggaaagauccaaggcaugcucacccaaaccacaagagaggauggcucgacccgcgccacaaaagccacagugagcacugggaguguccacuuuacuccaaagcugggcaguguucaguacaccgcugacacaaacaaugauuuucaaacuggccaaaacacgaaauucaccccagucggcgucauccaggacgguaguaaccaucaaaaugaaccccaacaaugggugcucacaaacuacucagguagaacuggucauaaugugcaccuagccccugccguugcccccacuuuuccgggugaacaacuucucuucuuuagguccacuaugcccggauguagcggguaucccaauaugaaucuggauugccuacucccccaggaaugggugcagcacuucuaccaagaagcagcuccagcacaaucugauguggcucuguugagauuugugaauccagacacagguaggguucuguuugagugcaagcuccauaaaucaggcuaugucacaguggcucacacuggcccgcaugauuugguuaucccccccaaugguuacuuuagauuugauccuugggucaaccaguucuacacacuugcccccaugggaaauggagcggggcgcagacgugcauuauag

SEQ ID NO: 5892 - RNA, 1623 nt, Artificial Sequence
  capsid_protein__Norovirus__AAR97648
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucacuacaaccaaucaaaugaccccaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauucccuauuccuuuggaaaaguuguucacggguccuagcggugccuuuguuguucaaccacaaaauggcaggugcacgacugauggcguacucuuaggcacuacccaacugucuccugucaacaucugcaccuucagaggggaugucacccacauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggagauggcucuacccgcggccacaaagcuacagugagcacuggggauguccacuucacuccaaagcugggcaguauucaguucaacacugauacaaacaaugauuuugaaacuggccaaaacacgaaauucaccccagucgguguuguccaggaugguaaugguacccaccaaaaugaaccucaacaaugggugcucccaagcuacucagguagaacuggucauaauguacaccuagcccccgccguagcccccacuuuuccgggugagcaacuucuuuucuucagguccacuaugcccggaugcagcggguaccccaacaugaauuuggauugucuacucccccaagaaugggugcagcacuucuaccaagaggcagcuccagcacaaucugauguggcucugcuaagauuugugaauccagacacagguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacgugcauuauaa

SEQ ID NO: 5893 - RNA, 1623 nt, Artificial Sequence
  capsid_protein__Norovirus__AAR97651
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguaucccccagaaacgcuccaggugaaauacuauggagcgcgcccuugggcccugaucugaaucccuaccuuucucauuuggccagaauguacaauggcuaugcagguggcuuugaagugcagguaauccuugcggggaaugcguuuaccgccgggaaaaucguauuugcagcagucccaccaaauuucccaacugaaggcuugagccccagccaggucacuauguucccccauauaauaguagauguuaggcaacuggaaccuguguugauccccuuaccugauguuaggaacaauuucuaucacuacaaccaaucaaaugaccccaccauuaaauugauagcaauguuguacacaccacuuagggcuaauaaugcuggggaagaugucuucacagucucuugucgaguccucacgaggccaucccccgauuuugauuucauauuuuuggugccgcccacaguugagucaagaacuaaaccauucaccgucccaauuuuaacuguugaggaaaugaccaauucaagauuccccauuccuuuggaaaaguuguucacggguccuagcagugccuuuguuguucaaccacaaaauggcaggugcacgacugauggcgugcucuuaggcacuacccaacugucuccugucaacaucugcaccuucagaggggaugucacccacauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggggauggcucuacccgcggccacaaagcuacagugagcacuggggauguccacuucacuccaaagcugggcaguauucaguucaacacugauacaaacaaugauuuugaaacuggccaaaacacgaaauucaccccagucgguguuguccaggaugguaaugguacccaccaaaaugaaccucaacaaugggugcucccaagcuacucagguagaacuggucauaauguacaccuagccccugccguagcccccacuuuuccgggugagcaacuucuuuucuucagguccacuaugcccggaugcagcggguaccccaacaugaauuuggauugccuacucccccaggaaugggugcagcacuucuaccaagaggcagcuccagcacaaucugauguggcucugcuaagauuugugaacccagacacagguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacgugcauuauaa

SEQ ID NO: 5894 - RNA, 1623 nt, Artificial Sequence
  capsid_protein__Norovirus__AAR97654
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacagugucaccuagaaacgcuccaggugaaauacuauggagcgcgcccuugggcccugaucugaaucccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucacuacaaccaaucaaaugaccccaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauuccccauuccuuuggaaaaguuguucacggguccuagcggugccuuuguuguucaaccacaaaauggcaggugcacgacugauggcgugcucuuaggcacuacccaacugucuccugucaacaucugcaccuucagaggggaugucacccacauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggggauggcucuacccgcggccacaaagcuacagugagcacuggggauguccacuucacuccaaagcugggcaguauucaguucaacacugauacaaacaaugauuuugaaacuggccaaaacacgaaauucaccccagucgguguuguccaggaugguaaugguacccaccaaaaugaaccucaacaaugggugcucccaagcuacucagguagaacuggucauaauguacaccuagcccccgccguagcccccacuuuuccgggugagcaacuucuuuucuucagguccacuaugcccggaugcagcggguaccccaacaugaauuuggauugucuacucccccaggaaugggugcagcacuucuaccaagaggcagcuccagcacaaucugauguggcucugcuaagauuugugaauccagacacagguaggguucuauucgagugcaagcuucauaaaucaggcuaugucacaguggcucacacuggccagcaugauuugguuaucccccccaauggcuacuuuagauuugauucuugggucaaccaauucuacacacuugcccccaugggaaaugggacggggcguagacgugcauuauaa

SEQ ID NO: 5895 - RNA, 1623 nt, Artificial Sequence
  capsid_protein__Norovirus__AAR97657
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacagugucaccuagaaacgcuccaggugaaauacuauggagcgcgcccuugggcccugaucugaaucccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucacuacaaccaaucaaaugaccccaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauuccccauuccuuuggaaaaguuguucacggguccuagcggugccuuuguuguucaaccacaaaauggcaggugcacgacugauggcgugcucuuaggcacuacccaacugucuccugucaacaucugcaccuucagaggggaugucacccacauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggggauggcucuacccgcggccacaaagcuacagugagcacuggggauguccacuucacuccaaagcugggcaguauucaguucaacacugauacaaacaaugauuuugaaacuggccaaaacacgaaauucaccccagucgguguuguccaggaugguaaugguacccaccaaaaugaaccucaacaaugggugcucccaagcuacucagguagaacuggucauaauguacaccuagcccccgccguagcccccacuuuuccgggugagcaacuucuuuucuucagguccacuaugcccggaugcagcggguaccccaacaugaauuuggauugucuacucccccaggaaugggugcagcacuucuaccaagaggcagcuccagcacaaucugauguggcucugcuaagauuugugaauccagacacagguaggguucuauucgagugcaagcuucauaaaucaggcuauguaacaguggcucacacuggccagcaugauuugguuaucccccccaauggcuacuuuagauuugauucuugggucaaccaauucuacacacuugcccccaugggaaaugggacggggcguagacgugcauuauaa

SEQ ID NO: 5896 - RNA, 1623 nt, Artificial Sequence; identical to SEQ ID NO: 5894
  capsid_protein__Norovirus__AAR97660

SEQ ID NO: 5897 - RNA, 1623 nt, Artificial Sequence
  capsid_protein__Norovirus__AAR97663
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucacuacaaccaauuaaaugaccccaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauuccccauuccuuuggaaaaguuguucacggguccuagcggugccuuuguuguucaaccacaaaauggcaggugcacgacugauggcgugcucuuaggcacuacccaacugucuccugucaacaucugcaccuucagaggggaugucacccacauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggggauggcucuacccgcggccacaaagcuacagugagcacuggggauguccacuucacuccaaagcugggcaguauucaguucaacacugauacaaacaaugauuuugaaacuggccaaaacacgaaauucaccccagucgguguuguccaggaugguaaugguacccaccaaaaugaaccccaacaaugggugcucccaagcuacucagguagaacuggucauaauguacaccuagcccccgccguagcccccacuuuuccgggugagcaacuucuuuucuucagguccacuaugcccggaugcagcggguaccccaacaugaauuuggauugucuacucccccaggaaugggugcagcacuucuaccaagaggcagcuccagcacaaucugauguggcucugcuaagauuugugaauccagacacagguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacgugcacuauaa

SEQ ID NO: 5898 - RNA, 1623 nt, Artificial Sequence
  capsid_protein__Norovirus__AAS86774
augaagauggcgucgaaugacgccgcuccaucuaaugauggugcagccggucucguaccagaggucaacaaugagacaauggcacuugaaccaguugcgggagcuucaaucgcugccccuuuaacuggucaaaacaaugugauagaccccuggauuagauuaaauuuuguacaagcccccaauggugaguuuacgguuuccccccgaaacucgccuggugaaauuuuguuaaauuuggaguuagggccugaauugaauccauauuuagcccauuuagcaagaauguauaaugguuaugcaggugggguugaggugcagguacugcuggcuggaaaugcguuuacagcgggcaaauugguauucgcagcaauccccccccauuuuccaguagauaauuugagccccggucagauuaccauguuuccccaugugauuauugauguuagaacacuugaaccuguuuuguuaccauuaccugauguuaggaauaauuucuuccauuacaaucaacagagugaucagcgcaugagacuuguugcuaugcuuuacaccccucuuagaucuaaugguucaggugaugaugucuucacugugucaugcaggguuuugaccaggccauccccugacuuugauuuuaacuauuugguucccccaacaguugaauccaaaacuaaacccuucucagucccagugcugacccucaaugagcugaccaacucucgcuuucccgucccgguugacgcuauguacaccagcccuaacgacucaauugugguccaaccucagaaugggagggcaaccauagacggugaguugcuuggcaccacucaacucauccccaguggcaucugcucauuuagaggaaaaauuacaacacauuugucagaugauaggcacuuguggaauauccaagucuccaacuugaauggcacuccguucgacccaacggacgacgugccugcaccauuggguaugccagacuuuucugggcaaauauuuggggugguuagucaaagggacacaggcaccaaccccgcaaacagagcucaugaugcuguccuugcaaccuacagugccaaauacacuccuaagcucggaucaguccaaauuggaacuugggacaccgaugauuuacuugaaagacagccuguuaaauucacgcccguuggucucaaugaaauuggacaagacaagcacuuugaccaauggguguugccaaauuauuccggugcccuaggacucaacaugcaccuggcuccugcuguauccccacucuuccccggggagagacugcuguucuuuagaucauacauaccuuuaaaagguggccauggggacccauuuauugauugucuugugccucaagaauggauacaacacuuuuaucaagagucagccccagcacaauccucgguggcucugcugagguaugugaauccagacacaggucgcacucuauuugaggccaaauuacacaaggaaggguuuaucaccgucucuaguacggaaaauaggccugugauuguccccccaaaugguuacuuuagguuugauucuugggucaaccaauuuuacucauuagcccccaugggaacuggcaaugggcguagaaggaugcaguaa

SEQ ID NO: 5899 - RNA, 1623 nt, Artificial Sequence
  capsid_protein__Norovirus__AAS86777
augaagauggcgucgaaugacgccgcuccaucuaaugauggugcagccggucucguaccagaggucaauaacgagacaauggcacuugaaccaguugcgggagcuucaaucgcugccccuuuaacuggucaaaacaaugugauagaccccuggauuagauuaaauuuuguacaagcccccaauggugaguucacgguuuccccccgaaacucgccuggugaaguuuuguuaaauuuggaguuagggccugaguugaauccauauuuagcccauuuagcaagaauguauaaugguuaugcaggugggguugaggugcagguacugcuggcuggaaaugcguuuacagcgggcaaauugguauucgcagcaauccccccccauuuuccaguagauaauuugagccccggucagauuaccauguuuccccaugugauuauugauguuagaacacuugaaccuguuuuguuaccauuaccugauguuaggaauaauuucuuccauuacaaucaacagagugaucagcgcaugagacuuguugcuaugcuuuacaccccucuuagaucuaaugguucaggugaugaugucuucacugugucaugcaggguucugaccaggccauccccugacuuugauuuuaacuauuugguucccccaacaguugaauccaaaacuaaacccuucucagucccaguguugacccucaaugagcugaccaacucucgcuuucccgucccgauugaugcuauguacaccagcccuaacgacucaauuguaguccaaccucagaaugggagggcaaccauagacggugaguugcuuggcaccacucaacucauucccaguggcaucugcucguuuagaggaaaaauuacaacacauuugucagaugauaggcacuuguggaauauccaagucuccaacuugaauggcacuccguucgacccaacagacgacgugccugcaccauuggguaugccagacuuuucugggcaaauauuuggggugguuagucaaagggacacaggcaccaaccccgcaaacagagcucaugaugcuguccuugcaaccuacagugccaaauacacuccuaagcucggaucaguccaaauuggaacuugggacaccgaggauuuacuugaaagacagccuguuaaauucacgcccguuggucucaaugaaauuggacaagacaagcacuuugaccaauggguguugccaaauuauuccggugcccuaggacucaacaugcaccuggcuccugcuguauccccacucuuccccggggagagauugcuguucuuuagaucauacauaccuuuaaaagguggcuauggggacccauuuauugauugucuugugccucaagaauggauacaacacuuuuaucaagagucagccccagcacaauccucgguggcucugcugagguaugugaauccagacacaggucgcacuuuauuugaggccaaauuacacaaggaaggguuuaucaccgucucuaguacggaaaauaggccugugauuguccccccaaaugguuacuuuagguuugauucuuggguuaaccaauuuuacucauuagcccccaugggaacuggcaaugggcguagaaggaugcaguaa

SEQ ID NO: 5900 - RNA, 1623 nt, Artificial Sequence
  capsid_protein__Norovirus__AAS86780
augaugauggcgucuaaggacgccccaacauccccugauggcgccaguggcgcuggccagcugguaccggaggcuaacacagcugagcaaauuucaauggacccuguugcgggugcuucaacagcagucgcaacagcugggcaaguuaauaugauugacccauggauuuucaauaacuuuguccaggcgccccaaggagaauuuacuaucuccccuaauaauacccccggugacauuuuguuugacuuacaauuaggaccccaccuuaauccauuucuagcccaccucucacaaauguauaaugguugggucggcaauaugcguguacguauauugcuggcagggaaugcuuucacagcuggcaagauaaucauuugcuguguccccccugguuuugaugcuagaauacuuacaauagcccaagcaacucucuuuccacacuugauugcugauguuaggacucuugagccuguggagcucccucuggaggacgugcgcaacguucucuaucacaacaguagccagccgcagccaacaaugcgguugguggcuauguuguacacuccccuccgcacuggugguggcuccggagguacugaugccuuugugguugcgggcagggugcucacgugccccgccccugauuuuagcuuucuguuucuugucccccccuccguugagcagaagacuaggguuuuuaguguccccaacauaccccuaaaagaccuuucaaauucucguguuccugugccuauacagggcauguucauguccccagaugucaaucagucaguccaguuucagaacgggcgcugccaaaucgauggucaacuccaaggcacuaccccuguuucgcucagucaacuuugcaagauuagggguaagacuucaagcaaugccagaguacucaacuuaagugagguggauggcacacccuuuguuccucuugagucuccagcaccaguugguuuucccgacuuaggagguugugacuggcauguaaacuucacuuuccaggcucagaaucaggacccaucucaaagugugaccuuugcaacuaaugaugcuagcuuuguucccuacuuaggcagcaucucuccucacaaugggggggauuuucaugcaggugacaucauaggcagucuuggcuggauuucagccccgucugauaauacacaacuuaaugucuggacaauaccaaaguauggguccagucucccagaugucacucaccuugcaccugcuguguuccccccaggcuuuggggaggugauucuguacuucuacucuacauucccagguucuggacaaccuagucagcuucaagucccaugccuguugccucaggaguucaucacccacuucugcaaugaacaggcucccaucgcuggggaagcugcucuccuccauuacguggacccugacacggggcggaaccugggggaauucaagcucuauccugauggguuuaugaccuguguccccaauaguguuagcagugguccucaaacccuuccuaucaauggagucuuugucuuuguuucauggguauccagauuuuaucaacucaagccugugggaacggccucagcggcuagaaggcuuggacugcggcguauauaa

SEQ ID NO: 5901 - RNA, 1623 nt, Artificial Sequence
  capsid_protein__Norovirus__AAS86783
augaugauggcgucuaaggacgccccaacauccccugauggcgcuaguggcgccggccagcugguaccggaggcuaauacagcugagcaaauuucaauggacccuguugcgggugcuucaacagcagucgcaacggcuggacaaguuaauaugauugacccauggauuuuuaacaacuuuguccaggcaccccaaggagaauucacuauuuccccuaauaauacccccggugauaucuuguuugaucuacaguuagggccccaccuuaacccauuuuuggcucaucuuucgcagauguacaauggauggguuggcaauaugcguguacguauauugcuggcagggaaugcuuuuacagcuggaaagauaauuaucugcuguguucccccugguuuugaugcuagaauacucacaauugcucaggcaacucuuuucccacaccugaucgcugauguuaggacucuugagcccguggaacucccucuggaggacgugcgcaacguucucuuucacaauagcagccagccgcaaccaacaaugcgauugguggcuauguuguacaccccacuccgcacgggcgguggcucuggaggcacugaugccuuugugguggcagguaggguacuuacgugcccugccccugacuuuagcuuuuuguuucuugucccuccuucugucgagcaaaagaccaggguguucagugucccuaauguaccucugaaagaccuuucaaauucucgugucccugugccuauacaggguauguuuauguccccagaugucaaccagucaguccaguuucagaaugggcgcugucagauugauggccagcuccagggcaccaccccugucucgcucagccagcuuugcaagaucagggguaagaccucgagcaaugccagagugcucaaucucagugagguagaugguucaccuuucaucccccucgaaucgccagcaccaguuggcuuucccgaccugggaggcugcgacuggcaugugaauuuuacuuuccaagcucaggaucaggacccaucucaaagugugaccuuugcaaccaaugaugcuagcuuuguuccauaccuaggcaguaucucuccccacaacgggggagauuuucauucaggugacaucauagguagccuuggcuggauuucugccccguccgacaguucccaacucaaugucuggacaauaccgaaguacggcuccagccucccagauguaacccaccuugcaccugcuguguuucccccagguuuuggggaggucaucuuguacuucuacuccacuuuuccagguucuggccaaccaguacaacuccaagucccaugucuauuaccucaggaguuuaucacucacuuuugcaaugaacaggcccccauugcuggggaggcugcccuccuccauuauguggauccugauacagggcgaaacuugggggaguucaagcuuuaccccgauggauucaugaccugugucccuaauaguguuaguaguggcccucaaacucuccccaucaauggagucuuugucuuuguuucaugggugucuagauucuaucaacuuaagccugugggaacggccucaguggccagaaggcuuggacuacggcgcauauaa

SEQ ID NO: 5902 - RNA, 1623 nt, Artificial Sequence
  capsid_protein__Norovirus__AAS86786
augaagauggcgucgaaugacgccgcuccaucuaacgauggugcuacgggccucgucccagagaucaacaacgagacccucccuuuggaaccaguugcgggugcagcaaucgccgcgccugucacuggccaaaauaauauaauugaucccuggauuagaacaaauuuuguacaagcacccaauggagaguucacugucucaccuagaaacuccccuggagaaauucuuuuaaauuuagaauuggguccugacuuaaauccauauuuggcacaucuaucuagaauguacaauggguaugccgguggcguggaaguccaaguccuccuagcagggaacgcguucacugcagggaagauccucuucgcugccgugccaccaaauuucccaguugaauucuugaguccugcacagauuacuauguugccacaccuaauaguugauguuagaacccuugaacccaucaugauaccacucccugauguuaggaacaccuucuuucauuacaacaaucaacccgccaaccgcaugcgauugguggcuauguuguauaccccuuugagaucuaaugguucuggugaugaugucuucacuguuucauguagagugcuaacuaggcccaccccagauuuugaguucacauacuuggucccuccuucaguagagucuaagacuaaacccuuuucucugccuauauuaacaauaucugaauuaaccaauucaagauuuccugcacccauagauucauuguuuacagcccagaauaacaaucucaauguccaaugucagaauggucggugcacacuggauggugaguugcagggaaccacucaacugcugcccucggguauaugugcuuucagggggagacuaacagcagauguagacggaagccacgaugacagauggcacaugcaguugaccaaccucaauggaacccccuuugauccaacagaggacgugccggcuccguuaggcaccccagacuucacaggccuccucuucggaguggcaagucagaggaauguuggguccaacccaaacaccacuagggcgcacgaggcuguggucuccacaaccaguucacaguuugugccaaaauuaggaucagucaacuuugguaguacuagcacugacuuccaacuacaacaacccaccaaauucacaccaguuggaaucaagauugaaaguggacacgaauuugaucagugggcccuaccuagauacucaggucacuugacccucaauaugaaccuugccccaccuauugccccaaauuucccuggugagcaguuguuguucuuuagaucaaauguuccuugugcugguggcgucagugauggugucaucgauugcuuguugccucaggaguggauacagcacuucuaucaggagucugcuccaucccagucugauguggcucugaucagguaugucaacccugacacuggccgcacacucuucgaggcgaaacuccacagaacaggcuacaucacuguugcccacucaggugauuauccccucguuguccccuccaauggauauuuuagauuugauuccugggucaaccaguuuuacucacucgcccccaugggaacaggaaaugggcgcagacgggugcaguaa

SEQ ID NO: 5903 - RNA, 1623 nt, Artificial Sequence
  capsid_protein__Norovirus__AAS86792
augaagauggcgucgaaugacgccgcuccaucuaaugauggugcagccggucucguaccagaggucaacaacgagacaauggcgcuugaaccaguugcgggagcuucaaucgccgccccuuugacuggucaaaacaauguaauagaccccuggauuagauuaaauuuuguacaagcccccaauggugaguucacgguuuccccccgaaacucgccuggugaaauuuuguuaaauuuagaguuagggccugaauugaauccauauuuagcccauuuagcaagaauguauaaugguuaugcaggugggguugaggugcagguacugcuggcugggaaugcguucacagcgggcaaauugguauuugcagcaauccccccccauuuuccaguagauaacuugagccccggucagaucacuauguuuccccaugugauuauugauguuagaacacuugaaccuguuuuguuaccauuacccgauguuaggaacaauuucuuccauuauaaucaacagagugaccaacgcaugaggcucauugcuaugcuuuauaccccucuaagaucuaaugguucaggugaugauguuuucacugugucauguagaguccuaaccaggccauccccugauuuugauuuuaacuauuuggucccuccaacaguugaauccaaaacuaaaccuuucucagucccagugcuaacccuuaaugagcugaccaauucucguuuucccgucccgauugaugccauguauaccagcccuaaugauucaauugugguccaaccucagaaugggagggcaaccauagauggugaguugcuuggcaccacccagcucauccccagugguaucugcucauucagaggaaaaauuacaacacauuugucagaugauaggcacuuguggaauguccaagucuccaacuugaauggcacuccguuugauccaacggacgacgugccugcaccauuggguaugccagacuuuucugggcaaauauuugggguaguuagucaaagggacacaggcaccaaccccgcaaacagggcucaugaugcuguucuugcaaccuacagugccaaauauacuccuaagcucgguucaguccaaauuggaacuugggacaccgaggauuuacuugaaaggcagccuguuaaauuuacgcccguuggucucaaugaaauuggacaagacaagcacuuugaccaauggguauugccaaauuauucuggugcucuaggacucaacaugcaccuggcuccugcuguauccccacucuucccuggggagagauugcuguucuuuagaucauacauaccucuaaaagguggccauggggacccauuuauugauugccuugugccgcaagaauggauacaacacuuuuaucaagagucagccccagcacaauccucgguggcccugcugagguaugugaauccagacacaggucgcacucuauuugaggccaaauuacacaaggaaggguuuaucaccgucuccaguacggaaaauaggccugugauuguccccccaaaugguuacuuuagguuugauucuuggguuaaccaauucuacucauuagcccccaugggaacugguaaugggcgcagaaggaugcaguaa

SEQ ID NO: 5904 - RNA, 1623 nt, Artificial Sequence
  capsid_protein__Norovirus__AAS86795
augaagauggcgucgaaugacgccgcuccaucuaaugauggugcagccggucucguaccagaggucaacaacgagacaauggcacuugaaccaguugcgggagcuucaaucgcugccccuuuaacuggucaaaacaaugugauagaccccuggauuagauuaaauuuuguacaagcccccaauggugaguuuacgguuuccccccgaaacucgccuggugaaauuuuguuaaauuuggaguuagggccugaauugaauccauauuuagcccauuuagcaagaauguauaaugguuaugcaggugggguugaggugcagguacugcuggcuggaaaugcguuuacagcgggcaaauugguauucgcagcaauccccccccauuuuccaguagauaaucugagccccggucagauuaccauguuuccccaugugauuauugauguuagaacacuugaaccuguuuuguuaccauuaccugauguuaggaauaauuucuuccauuacaaucaacagagugaucagcgcaugagacuuguugcuaugcuuuacaccccucuuagaucuaaugguucaggugaugaugucuucacugugucaugcaggguuuugaccaggccauccccugacuuugauuuuaacuauuugguucccccaacaguugaauccaaaacuaaacccuucucagucccagugcugacccucaaugagcugaccaacucucgcuuucccgucccgauugaugcuauguacaccagcccuaacgacucaauugugguccaaccucagaaugggagggcaaccauagacggugaguugcuuggcaccacucaacucauccccaguggcaucugcucauuuagaggaaaaauuacaacacauuugucagaugauaggcacuuguggaauauccaagucuccaacuugaauggcacuccguucgacccaacggacgacgugccugcaccauuggguaugccagauuuuucugggcaaauauuuggggugguuagucaaagggacacaggcaccaaccccgcaaacagagcucaugaugcuguccuugcaaccuacagugccaaauacacuccuaagcucggaucgguccaaauuggaacuugggacaccgaggauuuacuugaaagacagccuguuaaauucacgcccguuggucucaaugaaauuggacaagacaagcacuuugaccaauggguguugccaaauuauuccggugcccuaggacucaacaugcaccuggcuccugcuguauccccacucuuccccggggagagacugcuguucuuuagaucauacauaccuuuaaaagguggccauggggacccauuuauugauugucuugugccucaagaauggauacaacacuuuuaucaagagucagccccagcacaauccucgguggcucugcugagguaugugaauccagacacaggucgcacucuauuugaggccaaauuacacaaggaaggguuuaucaccgucucuaguacggaaaauaggccugugauuguccccccaaaugguuacuuuagguuugauucuuggguuaaccaauuuuacucauuagcccccaugggaacuggcaaugggcguagaaggaugcaguaa

SEQ ID NO: 5905 - RNA, 1623 nt, Artificial Sequence
  capsid_protein__Norovirus__AAS86798
augaagauggcgucgaaugacgccgcuccaucuaaugauggugcagccggucucguaccagaggucaacaacgagacaauggcacuugaaccaguugcgggagcuucaaucgcugccccuuuaacuggucaaaacaaugugauagaccccuggauuagauuaaauuuuguacaagcccccaauggugaguuuacgguuuccccccgaaacucgccuggugaaauuuuguuaaauuuggaguuagggccugaauugaauccauauuuagcccauuuagcaagaauguauaaugguuaugcaggugggguugaggugcagguacuguuggcuggaaaugcguuuacagcgggcaaauugguauucgcagcaauccccccccauuuuccaguagauaauuugagccccggucagauuaccauguuuccccaugugauuauugauguuagaacacuugaaccuguuuuguuaccauuaccugauguuaggaauaauuucuuccauuacagucaacagagugaucagcgcaugagacuuguugcuaugcuuuacaccccucuuagaucuaaugguucaggugaugaugucuucacugugucaugcagggucuugaccaggccauccccugacuuugauuuuaacuauuugguucccccaacaguugaauccaaaacuaaacccuucucagucccagugcugacccucaaugaguugaccaacucucgcuuucccgucccgauugaugcuauguacaccagcccuaacgacucaauugugguccaaccucagaaugggagggcaaccauagacggugaguugcuuggcaccacucaacucauccccaguggcaucugcucauuuagaggaaaaauuacaacacauuugucagaugauaggcacuuguggaauauccaagucuccaacuugaauggcacuccguucgacccaacggacgacgugccugcaccauuggguaugccagacuuuucugggcaaauauuuggggugguuagucaaagggacacaggcaccaaccccgcaaauagagcucaugaugcuguccuugcaacauacagugccaaauacacuccuaagcucggaucaguccaaauuggaacuugggacaccgaggauuuacuugaaagacagccuguuaaauucacgcccguuggucucaaugaaauuggacaagacaagcacuuugaccaauggguguugccaaauuauuccggugcccuaggacucaacaugcaccuggcuccugcuguauccccacucuuccccggggagagacugcuguucuuuagaucauacauaccuuuaaaagguggccauggggacccauuuauugauugucuugugccucaagaauggauacaacacuuuuaucaagagucagccccagcacaauccucgguggcucugcugagguaugugaauccagacacaggucgcacucuauuugaggccaaauuacacaaggaaggguuuaucaccgucucuaguacggaaaauaggccugugauuguccccccaaaugguuacuuuagguuugauucuuggguuaaccaauuuuacucauuagcccccaugggaacuggcaaugggcguagaaggaugcaguaa

SEQ ID NO: 5906 - RNA, 1623 nt, Artificial Sequence
  capsid_protein__Norovirus__AAS86801
augaagauggcgucgaaugacgccgcuccaucuaaugauggugcagccggucucguaccagaggucaacaacgagacaauggcacuugaaccaguugcgggagcuucaaucgcugccccuuuaacuggucaaaacaaugugauagaccccuggauuagauuaaauuuuguacaagcccccaauggugaguuuacgguuuccccccgaaacucgccuggugaaauuuuguuaaauuuggaguuagggccugaauugaauccauauuuagcccauuuagcaagaauguauaaugguuaugcaggugggguugaggugcagguacugcuggcuggaaaugcguuuacagcgggcaaauugguauucgcagcaauccccccccauuuuccaguagauaauuugagccccggucagauuaccauguuuccccaugugauuauugauguuagaacacuugaaccuguuuuguuaccauuaccugauguuaggaauaauuucuuccauuacaaucaacagagugaucagcgcaugagacuuguugcuaugcuuuacacuccucuuagaucuaaugguucaggugaugaugucuucacugugucaugcaggguuuugaccaggccauccccugacuuugauuuuaacuauuugguucccccaacaguugaauccaaaacuaaacccuucucagucccagugcugacccucaaugagcugaccaacucucgcuuucccgucccgauugaugcuauguacaccagcccuaacgacucaauugugguccaaccucagaaugggagggcaaccauagacggugaguugcuuggcaccacucaacucauccccaguggcaucugcucauuuagaggaaaaauuacaacacauuugucagaugauaggcacuuguggaauauccaagucuccaacuugaauggcacuccguucgacccaacggacgacgugccugcaccauuggguaugccagacuuuucugggcaaauauuuggggugguuagucaaagggacacaggcaccaaccccgcaaacagagcucaugaugcuguccuugcaaccuacagugccaaauacacuccuaagcucggaucaguccaaauuggaacuugggacaccgaggauuuacuugaaagacagccuguuaaauucacgcccguuggucucaaugaaauuggacaagacaagcacuuugaccaauggguguugccaaauuauuccggugcccuaggacucaacaugcaccuggcuccugcuguauccccacucuuccccggggagagacugcuguucuuuagaucauacauaccuuuaaaagguggccauggggacccauuuauugauugucuugugccucaagaauggauacaacacuuuuaucaagagucagccccagcacaauccucgguggcucugcugagguaugugaauccagacacaggucgcacucuauuugaggccaaauuacacaaggaaggguuuaucaccgucucuaguacggaaaauaggccuguaauuguccccccaaaugguuacuuuagguuugauucuuggguuaaccaauuuuacucauuagcccccaugggaacuggcaaugggcguagaaggaugcaguaa

SEQ ID NO: 5907 - RNA, 1623 nt, Artificial Sequence
  capsid_protein__Norovirus__AAS86804
augaagauggcgucgaaugacgccgcuccaucuaaugauggugcagccggucucguaccagaggucaacaacgagacaauggcacuugaaccaguugcgggagcuucaaucgcugccccuuuaacuggucaaaacaaugugauagaccccuggauuagauuaaauuuuguacaagcccccaauggugaguuuacgguuuccccccgaaacucgccuggugaaguuuuguuaaauuuggaguuagggccugaauugaauccauauuuagcccauuuaucaagaauguauaaugguuaugcaggugggguugaggugcaggugcugcuggcuggaaaugcguuuacagcgggaaaauugguauuugcagcaauucccccccauuuuccaguagauaauuugagccccggucagauuaccauguuuccccaugugauuauugauguuagaacacuugaaccuguuuuguuaccauuaccugauguuaggaauaauuucuuucauuacaaucaacagagugaucagcgcaugagacuuauugcuaugcuuuacaccccucuuagaucuaaugguucaggugaugaugucuucacugugucaugcaggguuuugaccaggccauccccugacuuugauuuuaacuauuugguucccccaacaguugaauccaaaacuaaacccuucucagucccagugcugacccucaaugagcugaccaacucucgcuuccccgucccgauugaugcuauguacaccagcccuaacgacucaguugugguccaaccucagaaugggagggcaaccauagacggugaguugcuuggcaccacucaacucauccccaguggcaucugcucauuuagaggaaaaauuacaacacauuugucagaugauaggcacuuguggaauauccaagucuccaacuugaauggcacuccguucgauccaacggacgacgugccugcaccauuggguaugccagacuuuucugggcaaauauuuggggugauuagucaaagggauacaggcaccaaccccgcaaacagagcucaugaugcuguucuugcaaccuacagugccaaauacacuccuaagcucggaucaguccaaauuggaacuugggacaccgaggauuuacuugaaagacagccuguuaaauucacgcccguuggucucaaugaaauuggacaagacaagcacuuugaccaauggguguugccaaauuauuccggugcccuaggacucaacaugcaccuggcuccugcuguauccccgcucuuccccggggagagacugcuguucuuuagaucauacauaccuuuaaaagguggccaugggaacccauuuauugauugucuugugccucaagaauggauacaacacuuuuaucaagagucagccccagcacaauccucgguggcucugcugagguaugugaauccagacacaggucgcacucuauuugaggccaaauuacacaaggaaggguuuauuaccgucucuaguacggaaaauaggccugugauuguccccccaaaugguuacuuuagguuugauucuuggguuaaccaauuuuacucauuagcccccaugggaacugguaaugggcguagaaggaugcaguaa

SEQ ID NO: 5908 - RNA, 1593 nt, Artificial Sequence
  capsid_protein__Norovirus__AAS86807
augaugauggcgucuaaggacgcuacgucaaacguggauggcgccaguggcgcuggucaguugguaccggaggcuaacacuucugacccccuugcaauggauccuguagcggguucuucaacggcagucgcgacugcugggcaaguaaaucccauugauccuuggauaauuaauaauuuugugcaagcuccccaaggggaguuuacaaucucuccaaacaauacccccggugaugucuuauuugaucugaguuuagguccccaucuuaaccccuucuugcuacaucugucacaaauguauaaugguuggguugguaacaugagaguuaggaucaugcuggccgguaaugcuuuuacugcagguaagaucauaguuuccuguauaccuccugguuuuggaucgcauaaucuuacuauagcacaaucaacucuauuuccacaugugauugcugaugucaggacucuagacccuauugaaguaccuuuggaagauguuaggaauguucuuuuucauaauaaugacaggaaucaacaaaccaugcgccuugugugcauguuguauaccccccuccguacugguggugguacaggugacuccuuugugguggcggggcgaguuaugaccugcccuagcccugauuuuaauuucuuguucuuggucccccccacaguggagcagaaaacuagaccuuucacccuuccaaauuugccuuugagcucucuguccaauucacgugcuccucuuccaauuaguagcaugggcauuuccccagauaauguccagaguguacaguuccaaaauggucgguguacuuuggacggccguuugguuggcaccaccccaguuucacugucccagguugcuaagauaagaggcacuuccaauggcacugucaucaaccucaccgaauuggauggcacaccuuuucacccuuuugagggcccugcccccauuggauucccagaucuuggugguugugacuggcaugucaacaugacacaauuuggucacucuagucagacacaauuugauguggauaccaccccugaaaccuuuguuccucauuugggaucaauccaggcaaaugguguugguaguggcaauuacauugguguucucaguuggaucucccccccaucacauccuucugguucccagguggaccucuggaagauccccaauuaugggucgagcauuacugaggcaacacacuuggccccaucaguguucccacccgguuuuggggaagugcuggucuucuuuaugucaaagauaccaggaccuggcgccuacaaucugcccugccugcugccacaagaguacaucucacauuuugcaagcgagcaagcccccacugugggcgaggcugcucugcuccauuauguugacccugauacagggcggaaccuuggggaguuuaaagcauaccccgaugguuuccucacuuguguccccaauggagcuagcucggguccacaacaauuaccaaucaaugggguuuuuguuuuugucucuugggugucuagauucuaucaauugaagccugugggaacugccagcucggcaagagguaggcuuggauugcgccgauaa

SEQ ID NO: 5909 - RNA, 1623 nt, Artificial Sequence
  capsid_protein__Norovirus__AAT00237
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucauuacaaccaaucaaaugaccccaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauucccuauuccuuuggaaaaguuguucacggguccuagcggugccuuuguuguucaaccacaaaauggcaggugcacgacugauggcguacucuuaggcacuacccaacugucuccugucaacaucugcgccuucagaggggaugucacccacauugcaggcacucauaauuacacaaugaauuuggcuucucaaaauuggaacaauuaugacccaacagaagaaaucccagccccucuggggaccccagauuucgugggaaggauccaaggcaugcucacccaaacuacaaggggagauggcucuacccgcggccacaaagcuacagugagcacuggggauguccacuucacuccaaagcuaggcaguauucaguucaacacugauacaaacaaugauuuugaaacuggccaaaacacgaaauucaccccagucgguguuguccaggaugguaaugguacccaccaaaaugaaccucaacaaugggugcucccaagcuacucagguagaacuggucauaauguacaccuagcccccgccguagcccccacuuuuccgggugagcaacuucuuuucuucagguccacuaugcccggaugcagcggguaccccaacaugaauuuggauugucuacucccccaagaaugggugcagcacuucuaccaagaggcagcuccagcacaaucugauguggcucugcuaagauuugugaauccagacacagguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacgugcauuauaa

SEQ ID NO: 5910 - RNA, 1623 nt, Artificial Sequence; identical to SEQ ID NO: 5909
  capsid_protein__Norovirus__AAT00240

SEQ ID NO: 5911 - RNA, 1623 nt, Artificial Sequence
  capsid_protein__Norovirus__AAT00243
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucauuacaaccaaucaaaugaccccaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauucccuauuccuuuggaaaaguuguucacggguccuagcggugccuuuguuguucaaccacaaaauggcaggugcacgacugauggcguacucuuaggcacuacccaacugucuccugucaacaucugcgccuucagaggggaugucacccacauugcaggcacucauaauuacacaaugaauuuggcuucucaaaauuggaacaauuaugacccaacagaagaaaucccagccccucuggggaccccagauuucgugggaaggauccaaggcaugcucacccaaacuacaaggggagauggcucuacccgcggccacaaagcuacagugagcacuggggauguccacuucacuccaaagcuaggcaguauucaguucaacacugauacaaacaaugauuuugaaacuggccaaaacacgaaauucaccccagucgguguuguccaggaugguaaugguacccaccaaaaugaaccucaacaaugggugcucccaagcuacucagguagaacuggucauaauguacaccuagcccccgccguagcccccacuuuuccgggugagcaacuucuuuucuucagguccacuaugcccggaugcagcggguaccccaacaugaauuuggauugucuacucccccaagaaugggugcagcacuucuaccaagaggcagcuccagcacaaucugauguggcccugcuaagauuugugaauccagacacagguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacgugcauuauaa

SEQ ID NO: 5912 - RNA, 1623 nt, Artificial Sequence; identical to SEQ ID NO: 5911
  capsid_protein__Norovirus__AAT00246

SEQ ID NO: 5913 - RNA, 1623 nt, Artificial Sequence
  capsid_protein__Norovirus__AAT00249
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucauuacaaccaaucaaaugaccccaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauucccuauuccuuuggaaaaguuguucacggguccuagcggugccuuuguuguucaaccacaaaauggcaggugcacgacugauggcguacucuuaggcacuacccaacugucuccugucaacaucugcgccuucagaggggaugucacccacauugcaggcacucauaauuacacaaugaauuuggcuucucaaaauuggaacaauuaugacccaacagaagaaaucccagccccucuggggaccccagauuucgugggaaggauccaaggcaugcucacccaaacuacaaggggagauggcucuacccgcggccacaaagcuacagugagcacuggggauguccacuucacuccaaagcuaggcaguauucaguucaacacugauacaaacaaugauuuugaaacuggccaaaacacgaaauucaccccagucgguguuguccaggaugguaaugguacccaccaaaaugaaccucaacaaugggugcucccaagcuacucagguagaacuggucauaauguacaccuagcccccgccguagcccccacuuuuccgggugagcaacuucuuuucuucagguccacuaugcccggaugcagcggguaccccaacaugaauuuggauugucuacucccccaagaaugggugcagcacuucuaccaagaggcagcuccagcacaaucugauguggcccugcuaagauuugugaauccagacacagguaggguucuauuugagugcaagcuucauaaaacaggcuaugucacaguggcucacacuggccagcaugauuugguuaucccccccaauggcuacuuuagauuugauuccugggucaaccaauucuacacacuugcccccaugggaaaugggacggggcguagacgugcauuauaa

SEQ ID NO: 5914 - RNA, 1623 nt, Artificial Sequence
  capsid_protein__Norovirus__AAT00255
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaccauuacaaccaaucaaaugaccccaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauucccuauuccuuuggaaaaguuguucacggguccuagcggugccuuuguuguucaaccacaaaauggcaggugcacgacugauggcguacucuuaggcacuacccaacugucuccugucaacaucugcaccuucagaggggaugucacccauauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggagauggcucuacccgcggccacaaagcuacagugagcacuggggauguccacuucacuccaaagcuaggcaguauucaguucaacacugauacaaacaaugauuuugaaacuggccaaaacacgagauucaccccaguugguguuguccaggaugguaauggcacccaccaaaaugaaccucaacaaugggugcucccaagcuacucagguagaacuggucauaauguacaccuagcccccgccguagcccccacuuuuccgggugagcaacuucuuuucuucagguccacuaugcccggaugcagcggguaccccaacaugaauuuggauugucuacucccccaagaaugggugcagcacuucuaccaagaggcagcuccagcacaaucugauguggcucugcuaagauuugugaauccagacacagguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacgugcauuauaa

SEQ ID NO: 5915 - RNA, 1623 nt, Artificial Sequence
  capsid_protein__Norovirus__AAT00258
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaccauuacaaccaaucaaaugaccccaccauuaaauugauagcaaugcuguacacaccacuuagggcuaauaaugcuggggaagaugucuucacagucucuugucgaguccucacgaggccaucccccgacuuugauuucauauuuuuggugccacccacaguugagucaagaacuaaaccauucaccgucccaauuuuaacuguugaggaaaugaccaauucaagauucccuauuccuuuggaaaaguuguucacggguccuagcggugccuuuguuguucaaccacaaaauggcaggugcacgacugauggcguacucuuaggcacuacccaacugucuccugucaacaucugcaccuucagaggggaugucacccauauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggagauggcucuacccgcggccacaaagcuacagugagcacuggggauguccacuucacuccaaagcuaggcaguauucaguucaacacugauacaaacaaugauuuugaaacuggccaaaacacgagauucaccccaguugguguuguccaggaugguaauggcacccaccaaaaugaaccucaacaaugggugcucccaagcuacucagguagaacuggucauaauguacaccuagcccccgccguagcccccacuuuuccgggugagcaacuucuuuucuucagguccacuaugcccggaugcagcggguaccccaacaugaauuuggauugucuacucccccaagaaugggugcagcacuucuaccaagaggcagcuccagcacaaucugauguggcucugcuaagauuugugaauccagacacagguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacgugcauuauaa

SEQ ID NO: 5916 - RNA, 1623 nt, Artificial Sequence
  capsid_protein__Norovirus__AAT00261
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggagccuguguugauccccuuaccugauguuaggaacaauuucuaccauuacaaccaaucaaaugaccccaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauucccuauuccuuuggaaaaguuguucacggguccuagcggugccuuuguuguucaaccacaaaauggcaggugcacgacugauggcguacucuuaggcacuacccaacugucuccugucaacaucugcaccuucagaggggaugucacccauauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggagauggcucuacccgcggccacaaagcuacagugagcacuggggauguccacuucacuccaaagcuaggcaguauucaguucaacacugauacaaacaaugauuuugaaacuggccaaaacacgagauucaccccaguugguguuguccaggaugguaauggcacccaccaaaaugaaccucaacaaugggugcucccaagcuacucagguagaacuggucauaauguacaccuagcccccgccguagcccccacuuuuccgggugagcaacuucuuuucuucagguccacuaugcccggaugcagcggguaccccaacaugaauuuggauugucuacucccccaagaaugggugcagcacuucuaccaagaggcagcuccagcacaaucugauguggcucugcuaagauuugugaauccagacacagguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacgugcauuauaa

SEQ ID NO: 5917 - RNA, 1623 nt, Artificial Sequence; identical to SEQ ID NO: 5914
  capsid_protein__Norovirus__AAT00264

SEQ ID NO: 5918 - RNA, 1623 nt, Artificial Sequence; identical to SEQ ID NO: 5914
  capsid_protein__Norovirus__AAT00267

SEQ ID NO: 5919 - RNA, 1623 nt, Artificial Sequence; identical to SEQ ID NO: 5914
  capsid_protein__Norovirus__AAT00270

SEQ ID NO: 5920 - RNA, 1623 nt, Artificial Sequence; identical to SEQ ID NO: 5914
  capsid_protein__Norovirus__AAT00273

SEQ ID NO: 5921 - RNA, 1623 nt, Artificial Sequence
  capsid_protein__Norovirus__AAT00276
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucauuuggccagaauguacaauggcuaugcagguggcuucgaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucauuacaaccaaucaaaugaccccaccauuaaauugauagcaaugcuguacacaccacuuagggcuaauaaugcuggggaagaugucuucacagucucuugucgaguccucacgaggccaucccccgauuuugauuuuauauuuuuggugccacccacaguugagucaagaacuaaaccauucaccgucccaauuuuaacuguugaggaaaugaccaauucaagauucccuauuccuuuggaaaaguuguucacggguccuagcggugccuuuguuguucaaccacaaaauggcaggugcacgacugauggcgugcucuuaggcacuacccaacugucuccugucaacaucugcaccuucagaggggaugucacccacauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggagauggcucuacccgcggccacaaagcuacagugagcacuggggauguccacuucacuccaaagcuaggcaguauucaguucaacacugauacaaacaaugauuuugaaacuggccaaaacacgagauucaccccagucgguguuguccaggaugguaauggcacccaccaaaaugaaccucaacaaugggugcucccaagcuacucagguagaacuggucauaauguacaccuagcccccgccguagcccccacuuuuccgggugagcaacuucuuuucuucagguccacuaugcccggaugcagcggguaccccaacaugaauuuggauugucuacucccccaagaaugggugcagcacuucuaccaagaggcagcuccagcacaaucugauguggcucugcuaagauuugugaauccagacacagguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacgugcauuauaa

SEQ ID NO: 5922 - RNA, 1623 nt, Artificial Sequence
  capsid_protein__Norovirus__AAT00279
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucauuuggccagaauguacaauggcuaugcagguggcuucgaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucauuacaaccaaucaaaugaccccaccauuaaauugauagcaaugcuguacacaccacuuagggcuaauaaugcuggggaagaugucuucacagucucuugucgaguccucacgaggccaucccccgauuuugauuuuauauuuuuggugccacccacaguugagucaagaacuaaaccauucaccgucccaauuuuaacuguugaggaaaugaccaauucaagauucccuauuccuuuggaaaaguuguucacggguccuagcggugccuuuguuguucaaccacaaaauggcaggugcacgacugauggcgugcucuuaggcacuacccaacugucuccugucaacaucugcaccuucagaggggaugucacccacauugcagguacucauaauuacacaaugaauuuggcuucucaaaauuggaacaauuaugacccaacagaagagaucccagccccucuggggaccccagauuucgugggaaggauccaaggcaugcucacccaaacuacaaggggagauggcucuacccgcggccacaaagcuacagugagcacuggggauguccacuucacuccaaagcuaggcaguauucaguucaacacugauacaaacaaugauuuugaaacuggccaaaacacgagauucaccccagucgguguuguccaggaugguaauggcacccaccaaaaugaaccucaacaaugggugcucccaagcuacucagguagaacuggucauaauguacaccuagcccccgccguagcccccacuuuuccgggugagcaacuucuuuucuucagguccacuaugcccggaugcagcggguaccccaacaugaauuuggauugucuacucccccaagaaugggugcagcacuucuaccaagaggcagcuccagcacaaucugauguggcucugcuaagauuugugaauccagacacagguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacgugcauuauaa

SEQ ID NO: 5923 - RNA, 1623 nt, Artificial Sequence; identical to SEQ ID NO: 5914
  capsid_protein__Norovirus__AAT00282

SEQ ID NO: 5924 - RNA, 1623 nt, Artificial Sequence; identical to SEQ ID NO: 5914
  capsid_protein__Norovirus__AAT00285

SEQ ID NO: 5925 - RNA, 1623 nt, Artificial Sequence; identical to SEQ ID NO: 5914
  capsid_protein__Norovirus__AAT00288

SEQ ID NO: 5926 - RNA, 1623 nt, Artificial Sequence; identical to SEQ ID NO: 5914
  capsid_protein__Norovirus__AAT00291

SEQ ID NO: 5927 - RNA, 1623 nt, Artificial Sequence; identical to SEQ ID NO: 5914
  capsid_protein__Norovirus__AAT00294

SEQ ID NO: 5928 - RNA, 1623 nt, Artificial Sequence; identical to SEQ ID NO: 5914
  capsid_protein__Norovirus__AAT00297

SEQ ID NO: 5929 - RNA, 1623 nt, Artificial Sequence; identical to SEQ ID NO: 5914
  capsid_protein__Norovirus__AAT00300

SEQ ID NO: 5930 - RNA, 1623 nt, Artificial Sequence; identical to SEQ ID NO: 5914
  capsid_protein__Norovirus__AAT00303

SEQ ID NO: 5931 - RNA, 1623 nt, Artificial Sequence; identical to SEQ ID NO: 5914
  capsid_protein__Norovirus__AAT00306

SEQ ID NO: 5932 - RNA, 1623 nt, Artificial Sequence; identical to SEQ ID NO: 5914
  capsid_protein__Norovirus__AAT00309

SEQ ID NO: 5933 - RNA, 1623 nt, Artificial Sequence; identical to SEQ ID NO: 5914
  capsid_protein__Norovirus__AAT00312

SEQ ID NO: 5934 - RNA, 1623 nt, Artificial Sequence; identical to SEQ ID NO: 5914
  capsid_protein__Norovirus__AAT00315

SEQ ID NO: 5935 - RNA, 1623 nt, Artificial Sequence; identical to SEQ ID NO: 5914
  capsid_protein__Norovirus__AAT00318

SEQ ID NO: 5936 - RNA, 1623 nt, Artificial Sequence; identical to SEQ ID NO: 5914
  capsid_protein__Norovirus__AAT00321

SEQ ID NO: 5937 - RNA, 1623 nt, Artificial Sequence; identical to SEQ ID NO: 5909
  capsid_protein__Norovirus__AAT00324

SEQ ID NO: 5938 - RNA, 1623 nt, Artificial Sequence
  capsid_protein__Norovirus__AAT00330
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguaucuccuagaaacgcuccaggugaaauacuauggagcgcgcccuugggcccugaucugaaucccuaccuuucucauuuggccagaauguacaaugguuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucacuacaaccaaucaaaugaccccaccauuaaauugauagcaaugcuguacacaccacuuagggcuaauaaugcuggggaagaugucuucacagucucuugucgaguccucacgaggccaucccccgauuuugauuuuauauuuuuggugccacccacaguugagucaagaacuaaaccauucaccgucccaauuuuaacuguugaggaaaugaccaauucaagauucccuauuccuuuggaaaaguuguucacggguccuagcggugccuuuguuguucaaccacaaaauggcaggugcacgacugauggcguacucuuaggcaccacccaacugucuccugucaacaucugcaccuucagaggggaugucacccacauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggagauggcucuacccgcggccacaaagcuacagugagcacuggggauguccacuucacuccaaagcugggcaguauucaguucaacacugauacaaacaaugauuuugaaacuggccaaaacacgaaauucaccccagucgguguuguccaggaugguaaugguacccaccaaaaugaaccucaacaaugggugcucccaagcuacucagguagaacuggucauaauguacaccuagcccccgccguagcccccacuuuuccgggugagcaacuucuuuucuucagguccgcuaugcccggaugcagcggguaccccaacaugaauuuggauugucuacucccccaagaaugggugcagcacuucuaucaagaggcagcuccagcacaaucugauguggcucugcuaagauuugugaauccagacacagguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacgugcauuauaa

SEQ ID NO: 5939 - RNA, 1623 nt, Artificial Sequence
  capsid_protein__Norovirus__AAT00333
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguaucuccuagaaacgcuccaggugaaauacuauggagcgcgcccuugggcccugaucugaaucccuaccuuucucauuuggccagaauguacaaugguuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucacuacaaccaaucaaaugaccccaccauuaaauugauagcaaugcuguacacaccacuuagggcuaauaaugcuggggaagaugucuucacagucucuugucgaguccucacgaggccaucccccgauuuugauuuuauauuuuuggugccacccacaguugagucaagaacuaaaccauucaccgucccaauuuuaacuguugaggaaaugaccaauucaagauucccuauuccuuuggaaaaguuguucacggguccuagcggugccuuuguuguucaaccacaaaauggcaggugcacgacugauggcguacucuuaggcaccacccaacugucuccugucaacaucugcaccuucagaggggaugucacccacauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggagauggcucuacccgcggccacaaagcuacagugagcacuggggauguccacuucacuccaaagcugggcaguauucaguucaacacugauacaaacaaugauuuugaaacuggccaaaacacgaaauucaccccagucgguguuguccaggaugguaaugguacccaccaaaaugaaccucaacaaugggugcucccaagcuacucagguagaacuggucauaauguacaccuagcccccgccguagcccccacuuuuccgggugagcaacuucuuuucuucagguccgcuaugcccggaugcagcggguaccccaacaugaauuuggauugucuacucccccaagaaugggugcagcacuucuaucaagaggcagcuccagcacaaucugauguggcucugcugagauuugugaauccagacacagguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacgugcauuauaa

SEQ ID NO: 5940 - RNA, 1623 nt, Artificial Sequence; identical to SEQ ID NO: 5938
  capsid_protein__Norovirus__AAT00336

SEQ ID NO: 5941 - RNA, 1623 nt, Artificial Sequence
  capsid_protein__Norovirus__AAT00342
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguguccccuagaaacgcuccaggugaaauacuauggagcgcgcccuugggcccugaucugaaccccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuuaagccccagccaggucacuauguucccccauauaauaguagauguuaggcaacuggaaccuguguugauccccuuaccugauguuaggaacaauuucuaucacuacaaccaaucaaaugaccccaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauucccuauuccuuuggaaaaguuguucacggguccuaguggugccuuuguuguucaaccacaaaauggcagguguacgacugauggcgugcucuuaggcacuacccaacugucuccugucaacaucugcaccuucagaggggaugucacccacauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggagauggcucuacccgcggccacaaagcuacagugagcacuggggauguccacuucacuccaaagcugggcaguguucaguucaacacugauacaaacaaugauuuugaaacuggccaaaacacgaaauucaccccagucgguguuguccaggaugguaauggugcccaccaaaaugaaccucaacaaugggugcucccaagcuacucagguagaacuggccauaauguacaccuagcccccgccguagcccccacuuuuccgggugagcaacuucuuuucuucagguccacuaugcccggaugcagcggguaccccaacaugaauuuggauugucuacucccccaggaaugggugcagcacuucuaucaagaggcagcuccagcacaaucugauguggcucugcuaagauuugugaauccagacacagguaggguucuauuugagugcaagcuucauaaaucaggcuaugucacaguggcucacacuggccagcaugauuugguuaucccccccaauggcuauuuuagguuugauuccugggucaaccaauucuacacacuugcccccaugggaaaugggacggggcguagacgugcauuauaa

SEQ ID NO: 5942 - RNA, 1623 nt, Artificial Sequence
  capsid_protein__Norovirus__AAT00345
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaccauuacaaccaaucaaaugaccccaccauuaaauugauagcaaugcuguacacaccacuuagggcuaauaaugcuggggaagaugucuucacagucucuugucgaguccucacgaggccaucccccgauuuugauuucauauuucuggugccacccacaguugagucaagaacuaaaccauucaccgucccaauuuuaacuguugaggaaaugaccaauucaagauucccuauuccuuuggaaaaguuguucacggguccuagcggugccuuuguuguucaaccacaaaauggcaggugcacgacugauggcguacucuuaggcacuacccaacugucuccugucaacaucugcaccuucagaggggaugucacccauauugcaggcacucauaauuacacaaugaauuuggcuucucaaaauuggaacaauuaugacccaacagaagaaaucccagccccucuggggaccccagauuucgugggaaggauccaaggcaugcucacccaaacuacaaggggagauggcucuacccgcggccacaaagcuacagugagcacuggggauguccacuucacuccaaagcuaggcaguauucaguucaacacugauacaaacaaugauuuugaaacuggccaaaacacgagauucaccccaguugguguuguccaggaugguaauggcacccaccaaaaugaaccucaacaaugggugcucccaagcuacucagguagaacuggucauaauguacaccuagcccccgccguagcccccacuuuuccgggugagcaacuucuuuucuucagguccacuaugcccggaugcagcggguaccccaacaugaauuuggauuguuuacucccccaagaaugggugcagcacuucuaccaagaggcagcuccagcacaaucugauguggcucugcuaagauuugugaauccagacacagguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacgugcauuauaa

SEQ ID NO: 5943 - RNA, 1623 nt, Artificial Sequence
  capsid_protein__Norovirus__AAT00348
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaccauuacaaccaaucaaaugaccccaccauuaaauugauagcaaugcuguacacaccacuuagggcuaauaaugcuggggaagaugucuucacagucucuugucgaguccucacgaggccaucccccgauuuugauuucauauuucuggugccacccacaguugagucaagaacuaaaccauucaccgucccaauuuuaacuguugaggaaaugaccaauucaagauucccuauuccuuuggaaaaguuguucacggguccuagcggugccuuuguuguucaaccacaaaauggcaggugcacgacugaugguguacucuuaggcacuacccaacugucuccugucaacaucugcaccuucagaggggaugucacccauauugcaggcacucauaauuacacaaugaauuuggcuucucaaaauuggaacaauuaugacccaacagaagaaaucccagccccucuggggaccccagauuucgugggaaggauccaaggcaugcucacccaaacuacaaggggagauggcucuacccgcggccacaaagcuacagugagcacuggggauguccacuucacuccaaagcuaggcaguauucaguucaacacugauacaaacaaugauuuugaaacuggccaaaacacgagauucaccccaguugguguuguccaggaugguaauggcacccaccaaaaugaaccucaacaaugggugcucccaagcuacucagguagaacuggucauaauguacaccuagcccccgccguagcccccacuuuuccgggugagcaacuucuuuucuucagguccacuacgcccggaugcagcggguaccccaacaugaauuuggauuguuuacucccccaagaaugggugcagcacuucuaccaagaggcagcuccagcacaaucugauguggcucugcuaagauuugugaauccagacacagguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacgugcauuauaa

SEQ ID NO: 5944 - RNA, 1623 nt, Artificial Sequence
  capsid_protein__Norovirus__AAT00351
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaccauuacaaccaaucaaaugaccccaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauucccuauuccuuuggaaaaguuguucacggguccuagcggugccuuuguuguucaaccacaaaauggcaggugcacgacugauggcguacucuuaggcacuacccaacugucuccugucaacaucugcaccuucagaggggaugucacccauauugcaggcacucauaauuacacaaugaauuuggcuucucaaaauuggaacaauuaugacccaacagaagaaaucccagccccucuggggaccccagauuucgugggaaggauccaaggcaugcucacccaaacuacaaggggagauggcucuacccgcggccacaaagcuacagugagcacuggggauguccacuucacuccaaagcuaggcaguauucaguucaacacugauacaaacaaugauuuugaaacuggccaaaacacgagauucaccccaguugguguuguccaggaugguaauggcacccaccaaaaugaaccucaacaaugggugcucccaagcuacucagguagaacuggucauaauguacaccuagcccccgccguagcccccacuuuuccgggugagcaacuucuuuucuucagguccacuaugcccggaugcagcggguaccccaacaugaauuuggauuguuuacucccccaagaaugggugcagcacuucuaccaagaggcagcuccagcacaaucugauguggcucugcuaagauuugugaauccagacacagguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacgugcauuauaa

SEQ ID NO: 5945 - RNA, 1623 nt, Artificial Sequence; identical to SEQ ID NO: 5944
  capsid_protein__Norovirus__AAT00354

SEQ ID NO: 5946 - RNA, 1623 nt, Artificial Sequence; identical to SEQ ID NO: 5944
  capsid_protein__Norovirus__AAT00357

SEQ ID NO: 5947 - RNA, 1623 nt, Artificial Sequence
  capsid_protein__Norovirus__AAT00360
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaccauuacaaccaaucaaaugaccccaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauucccuauuccuuuggaaaaguuguucacggguccuagcggugccuuuguuguucaaccacaaaauggcaggugcacgacugauggcguacucuuaggcacuacccaacugucuccugucaacaucugcaccuucagaggggaugucacccauauugcaggcacucauaauuacacaaugaauuuggcuucucaaaauuggaacaauuaugacccaacagaagaaaucccagccccucuggggaccccagauuucgugggaaggauccaaggcaugcucacccaaacuacaaggggagauggcucuacccgcggccacaaagcuacagugagcacuggggauguccacuucacuccaaagcuaggcaguauucaguucaacacugauacaaacaaugauuuugaaacuggccaaaauacgagauucaccccaguugguguuguccaggaugguaauggcacccaccaaaaugaaccucaacaaugggugcucccaagcuacucagguagaacuggucauaauguacaccuagcccccgccguagcccccacuuuuccgggugagcaacuucuuuucuucagguccacuaugcccggaugcagcggguaccccaacaugaauuuggauuguuuacucccccaagaaugggugcagcacuucuaccaagaggcagcuccagcacaaucugauguggcucugcuaagauuugugaauccagacacagguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacgugcauuauaa

SEQ ID NO: 5948 - RNA, 1623 nt, Artificial Sequence; identical to SEQ ID NO: 5909
  capsid_protein__Norovirus__AAT00363

SEQ ID NO: 5949 - RNA, 1623 nt, Artificial Sequence; identical to SEQ ID NO: 5944
  capsid_protein__Norovirus__AAT00366

SEQ ID NO: 5950 - RNA, 1623 nt, Artificial Sequence
  capsid_protein__Norovirus__AAT00369
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucauuacaaccaaucaaaugaccccaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauucccuauuccuuuggaaaaguuguucacggguccuagcggugccuuuguuguucaaccacaaaauggcaggugcacgacugauggcguacucuuaggcacuacccaacugucuccugucaacaucugcaccuucagaggggaugucacccauauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggagauggcucuacccgcggccacaaagcuacagugagcacuggggauguccacuucacuccaaagcuaggcaguauucaguucaacacugauacaaacaaugauuuugaaacuggccaaaacacgagauucaccccaguugguguuguccaggaugguaauggcacccaccaaaaugaaccucaacaaugggugcucccaagcuacucagguagaacuggucauaauguacaccuagcccccgccguagcccccacuuuuccgggugagcaacuucuuuucuucagguccacuaugcccggaugcagcggguaccccaacaugaauuuggauugucuacucccccaagaaugggugcagcacuucuaccaagaggcagcuccagcacaaucugauguggcucugcuaagauuugugaauccagacacagguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacgugcauuauaa

SEQ ID NO: 5951 - RNA, 1623 nt, Artificial Sequence
  capsid_protein__Norovirus__AAT00372
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucauuacaaccaaucaaaugaccccacuauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauucccuauuccuuuggaaaaguuguucacggguccuagcggugccuuuguuguucaaccacaaaauggcaggugcacgacugauggcguacucuuaggcacuacccaacugucuccugucaacaucugcaccuucagaggggaugucacccacauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggagauggcucuacccgcggccacaaagcuacagugagcacuggggauguccacuucacuccaaagcuaggcaguauucaguucaacacugauacaaacaaugauuuugaaacuggccaaaacacgagauucaccccaguugguguuguccaggaugguaauggcacccaccaaaaugaaccucaacaaugggugcucccaagcuacucagguagaacuggucauaauguacaccuagcccccgccguagcccccacuuuuccgggugagcaacuucuuuucuucagguccacuaugcccggaugcagcggguaccccaacaugaauuuggauugucuacucccccaagaaugggugcagcacuucuaccaagaggcagcuccagcacaaucugauguggcucugcuaagauuugugaauccagacacagguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacgugcauuauaa

SEQ ID NO: 5952 - RNA, 1623 nt, Artificial Sequence
  capsid_protein__Norovirus__AAT00375
augaagauggcgucgaaugacgccaacccaucugauggguccacagccaaccucgucccggaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaccauuacaaccaaucaaaugaccccaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauucccuauuccuuuggaaaaguuguucacggguccuagcggugccuuuguuguucaaccacaaaauggcaggugcacgacugauggcguacucuuaggcacuacccaacugucuccugucaacaucugcaccuucagaggggaugucacccauauugcaggcacucauaauuacacaaugaauuuggcuucucaaaauuggaacaauuaugacccaacagaagaaaucccagccccucuggggaccccagauuucgugggaaggauccaaggcaugcucacccaaacuacaaggggagauggcucuacccgcggccacaaagcuacagugagcacuggggauguccacuucacuccaaagcuaggcaguauucaguucaacacugauacaaacaaugauuuugaaacuggccaaaacacgagauucaccccaguugguguuguccaggaugguaauggcacccaccaaaaugaaccucaacaaugggugcucccaagcuacucagguagaacuggucauaauguacaccuagcccccgccguagcccccacuuuuccgggugagcaacuucuuuucuucagguccacuaugcccggaugcagcggguaccccaacaugaauuuggauuguuuacucccccaagaaugggugcagcacuucuaccaagaggcagcuccagcacaaucugauguggcucugcuaagauuugugaauccagacacagguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacgugcauuauaa

SEQ ID NO: 5953 - RNA, 1647 nt, Artificial Sequence
  capsid_protein__Norovirus__AAT70110
augaagauggcgucuaaggacgccacuccaucuaaugauggugccgccggccucgucccagagaucaacaaugaggcaauggcgcuagauccaguggcgggugcagcgauagcagcaccccucacuggucagcaaaauauaauugaucccuggauuaugaauaauuuugugcaagcaccugguggugaguuuacaguauccccuaggaauuccccuggugaagugcuucuuaauuuggaauugggcccagaaauaaaucccuauuuggcccaucuugccagaauguauaaugguuaugcagguggauuugaagugcagguaguccuagcuggaaaugcguuuacagcaggaaagauaaucuuugcagcuauaccccccaauuuuccaauugauaaucuaagcgcagcacagaucacaaugugcccacaugugauuguggacgucagacaguuggaaccagucaaccucccgaugccugacguucgcaacaacuucuuccauuacaaucaagggucugauucgagauugcgcuuaauugcaaugcuguauacaccucuuagggcaaauaauucuggugaugauguuuuuacugugucuuguagagugcugacuaggccuagcccugacuucucauuuaauuuccuugugccaccuacuguggagucaaagacaaaacccuucacccucccuauucugacuaucuccgaaauguccaauucuagguuuccagugccgauugacucucugcacaccagcccaacugagaauauuguuguccagugccaaaaugggcgcgucacucuugauggugaguugaugggcaccacccaacucuuaccuagucaaaucugugcuuucaggggcgugcucaccagaucaacaagcagggccagugaucaggccgacacagcaaccccuagguuguuuaauuauuauuggcacauacaauuggauaaucuaaaugggacucccuaugauccugcagaagauauaccaggcccccuagggacgccagauuuccggggcaaagucuuuggcguggccagccagagaaaccccgacagcacaacuagagcacaugaagcaaagguggacacaacagcuggucguuucaccccaaaacuaggcucauuagagauauccacugaaucuggugacuuugaccaaaaccaaccaacaagauucaccccaguuggcauugggguugacaaugaagcagacuuucaacaauggucuuuaccugacuauucuggucaguucacccacaacaugaacuuagccccagcuguugcucccaacuucccuggugagcagcuccuuuucuuccgcucacaguuaccauccucuggugggcgauccaacgggauucuagacugccuggucccccaagaguggguucagcacuucuaccaagaaucggcccccucucaaacucaaguggcccugguuagguaugucaacccugacacugguagaguauuauuugaggccaagcugcacaaacuagguuucaugacuauagcuaagaauggugacucuccaauaacugucccuccaaauggauacuuuagguuugaaucuugggugaacccauuuuauacacuugcccccaugggaacugggaaugggcguagaaggauucaauaa

SEQ ID NO: 5954 - RNA, 1623 nt, Artificial Sequence
  capsid_protein__Norovirus__AAT73592
auggcgucuaaggacgccgcuccaucuacugauggugcagccggccucgugccagaaaguaauaaugaggucauggcucuugagccaguggcuggcgcugccuuggcggcuccagucacuggccaaacaaauauuauagacccuuggauuagaacaaauuuuguccaggccccuaauggugaauucacuguuucuccacgcaacgccccuggugaagugcuguuaaaucuagaguuggguccagaauuaaauccuuaucuggcacauuuggcaagaauguacaacggguaugccggcggaauggaggugcaggucauguuagcuggaaaugcguuuacagcuggaaaguuggucuucgccgcagucccaccucauuuucccguugaaaaucuuagcccacagcagaucacaauguuuccccaugugauuauugauguuaggacuuuggaaccuguccuguuaccacucccugauguuagaaauaauuucuuucauuacaaucaaaaggaugacccuaagaugagaauuguggcuaugcucuauacuccccucagaucaaaugguucuggugaugauguauucacaguuucuuguagaguguuaacuaggcccuccccugacuuugauuuuacguauuuggugccaccaacgguggaauccaaaacaaagccauucacacucccaauccuuacauuaggggagacgucuaauucaagauucccagugcccauagaucaaauguacacuagcccuaaugaaguuauuucugugcagugucagaauggcaggugcacacuggacggggagcuccaagggacaacacagcuccaggucagugguauuugcgcauucaaaggacaagugaccgcccaccuacaggacaaugaacaucuuuacaaugucaccaucacaaauuugaauggguccccuuuugaccccucugaggacauccccgcuccccuggguguucccgacuuugaagggaggguuuucggugucaucagccaaagagauaauuacaauucugguggacaaaaccagccugcaaauaggucucaugaugcuguggucccaacuuacacagcucaauauacuccaaaauugggucaaauucaaauuggcacguggcagacugaugauauaacagucgaccagccugcuaaauucaccccaguuggccuuagugauacagaccacuuuaaucaaugggugguucccagguaugcuggugcauuaaauuugaacacaaaucuugccccuuccguugcaccgguguucccaggagagcgguugcuuuucuuuagaucauacaucccccuuaaaggugguuuuggcaacccagccauugauugccuggugccacaggaguggauacagcacuucuaccaagaagcuacucccucacugagcgaggucgcccuugucagguauaucaauccggacacuggucgggcacuguuugaggccaagcuccacagggcuggcuucaugacagucucgaguaacaccagugccccggugguuguaccugccaauggguacuucagauuugauucuugggugaaccaauuuuauucucuugcccccaugggaacuggcaaugggcguagaaggauucaauaa

SEQ ID NO: 5955 - RNA, 1614 nt, Artificial Sequence
  capsid_protein__Norovirus__AAT78480
auggcgucuaaggacgccgcuccaucuaaugauggugcuacaggucucguaccagagaucaacacugagaccuuaccucuugagcccguggccggagcggcaauugcugccccuguuacgggccaaaauaacauaauugaucccuggauuagaaauaauuuugugcaggcgccuaauggugaguucacagucuccccaagaaauuccccuggugaaauuuuaaugaauuuggaguuaggaccagaucuuaauccauaucuggcucaccuuucaagaauguacaaugguuaugcuggagguguagaagugcaagugcuccuagccgggaaugcguucacagcaggaaagauccuuuuugcagcagucccuccaaauuuccccguugacaugcucagcccugcucaaauuacaaugcuuccccauuuaauuguagaugucagaaccuuggagccuauuaugauuccucugccugauguuaggaauguguucuaucacuuuaauaaccagccugccccaagaaugagauugguugcuaugcucuacaccccucuaagauccaacggguccggugaugauguauucacugucuccugcagggugcuaaccagaccuacaccagacuucgaguuuacauacuuagucccccccucgguagagucuaaaaccaagccuuuuacccuacccauccuaacaauuggagaguugacaaauucuagauuuccagccccgaucgaucaguuguauacuucacccaacgcugauguaguuguccaaccccaaaauggccggugcucacuggacggugagcuacaaggcacaacacaacuuuugacaacagcaauaugcucauacaggggcaugacaucaaaccccacuagggacuauugggauggucaccuccugcaccugguccaccccaauggggcaacauaugacccgaccgaggacgugccagcuccuuuuggcacgcaggacuuccggggcauucuguaugggguguugacucaaaauccccgagccuccggggacgaagccgccaacucccagggggucuacaucucauccaccagugaaaaguucacuccaaaauuggguacaauuggcuuacaccaagugcaagggcaccauagccagcaucaacagucaaaauucacaccauuaggaguagcagugaaugguaacacuccuuucagacagugggaacucccaaacuacucuggugcucuuacccucaacacaaaccuugcgccagcgguugggcccaacuucccuggggagcaaauccuuuucuucaggucaaauguuccaaguguccaagguggccaaccuauagagauugauugccugaucccacaagaauggguuucccacuuuuaucaagaaucagcccccucccagagugauguggccuuggucagguaugucaacccugacacagggcgcacaaucuuugaggccaaauugcauaggcagggauuuauuaccauagcggccacuggaagcaaccccguggucgugccucccaauggauauuuuagauuugauucaugggucaaccaguuuuaugcacucgcccccaugggaacugggaaugggcgcagaaggauucaguaa

SEQ ID NO: 5956 - RNA, 1635 nt, Artificial Sequence
  capsid_protein__Norovirus__AAT78481
auggcgucuaaggacgccccuucaaacauggacggcaccaguggugcuggucagcugguaccagaggcaaacacagcugauccuauucccuuagaaccuguaguaggggcugcaacugcagccgccacggcaggucaaguuaauaugauugaccccuggauuaugaauaauuuuguacagucgccagaaggcgaguucacaauuuccccaaacaacacgccuggugauauuuuguuugauuuacaauugggcccccauuugaauccauuucugcagcaccuaucacaaauguacaauggcuggguuggcaacaugaggguuaggauuuugcuggcagggaaugcguuuucugcugguaagauaauaauuuguugugugccaccuggcuucacugcccagaauaucucuauugcucaggccacaauguuuccacaugucauugcugauguucgaguucuggagccuauugaaaucccccuugaugauguucggaacgugcuuuuucauacaaaugagaacagacccacaaugcgcuuguugugcaugcucuacaccccauugcgggccggaggcgccucugcagguacagauccauucguaauugcaggucgcgucuuaacgugccccucuccagauuuuaauuucuuguuucuaguccccccuaguguagagcagaaaaccagacaauuaacuguccccaauaucccauuaaacaaucugucaaauucuagugugccugccaugauuaauaagauggcuaucuccucagaugcuaaucagguuguccaguuccaaaauggcaggugcaccacagauggucaguuguuaggcacaaccccaaucucugcgagucaaguggcccgcauccguggcaaggucuucuccacuucgucaggcaaaggacugaaucugucugagcuggauggcagcccguaccaugccuuugaaagccccgcuccaguugguuuuccggaucuuggacauugugauuggcaugucucuuccuucaaggcagaucaaaauucuaguggugaucccauuucacgcuuggauauaaaacaaggggcuuccuuugccccacaccuggguucuauugaauacaccacuucacaaaacccagaugguggucaauuaggcacccuaaccuggaucucauccccaucagaugacacgcccggccauggcacaaucaaccuauggaagaucccuuccuauggcuccacagucacugaaucuguccaucuugcacccccaauauacccuccaggguuuggggagacacuuguuaauuuaaugucuaacuuuccaauugggcauacuaauuccaauauggcacaagugccauguacccucccucaagaauuuguggcacacuuugucaaugagcaggcuccuguucgaggggacgcagcauugcuccacuauguggacccugacacacacagaaaucuuggugaguucaaauuauacccugaaggcuacauaaccugugugccaaacacugguggugguggcccccaaagucucccaaccaauggaguauucauauucucaucuuggguaucuagguauuaucaacuugagccugugggaacagcuggaccagcuaggaggcuuggaguuagaaggguauaa

SEQ ID NO: 5957 - RNA, 1620 nt, Artificial Sequence
  capsid_protein__Norovirus__AAU95776
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccgggugagauacuauggagcgcgcccuugggcccugauuugaacccuuaccuuucucauuuggccagaauguacaaugguuaugcagguggcuuugaagugcagguaauccucgcggggaacgcguucaccgccgggaaagucauauuugcagcagucccaccaaauuuuccaacugaaggcuugagccccagccagguuacuauguucccccauauaauaguagauguuaggcaacuggaaccuguguugauccccuuaccugaugucaggaacaauuucuaucauuacaaucaaucaaaugauuccaccauuaaauugauagcaaugcuguauacaccacuuaaggcuaauaaugcuggggaugaugucuucacagucucuugucgaguccucacaaggccaucccccgauuuugauuuuauauuuuuggugccacccacaguugaaucaagaacuaaaccguucaccgucccaauccuaacuguugaggaaauguccaauucaagguuccccaucccuuuggaaaaguuguacacgggucccagcagugcuuuugucguccaaccacaaaauggcaggugcacgacugauggugugcucuuaggcacuacccagcugucugcugucaacaucugcaccuucagaggggaugucacccacauugcaggcagucaugauuauacaaugaauuuggcuucucaaaauuggaacaauuaugacccaacagaagaaaucccagccccucugggaacuccagauuucgugggaaagauccaaggcaugcucacccaaaccacaagagaggauggcucgacccgcgcccacaaagcuacagugagcacugggaguguccacuuuacuccaaagcugggcaguguccaauacaccacugacacaaacaaugauuuucaaacuggccaaaacacgaaauucaccccagucggcgucauccaggacgguaauaaccaucaaaaugaaccccaacaaugggugcucccaaauuacucagguagaacuggucauaauguacaccuagcuccugccguugcccccacuuuuccgggugagcaacuucuuuucuuuagguccacuaugcccggguguagcggguauccuaacaugaaucuggauugccuacucccccaagaaugggugcagcacuucuaccaagaagcagcuccagcacaaucugauguggcucugcugagauuugugaauccagauacagguaggguucuguuugagugcaagcuucauaaaucaggcuaugucacaguggcucacacuggcccgcaugauuugguuaucccccccaaugguuacuucagauuugauuccugggucaaccaguucuacacacucgcccccaugggaaauggagcggggcguagacgugcauuauaa

SEQ ID NO: 5958 - RNA, 1644 nt, Artificial Sequence
  capsid_protein__Norovirus__AAX32874
augaagauggcgucuaaugacgcugccccaucuacggauggaucugccggucucguaccagaggucaauaaugagaccauggcccuggaaccaguagugggcgccccucuugccgcccccguugcuggucaacauaacauaauagaccccuggauuaaaaugaauuuugugcaggcaccuaauggagaguuuacuguuuccccucgcaaugccccaggugaaauuuuacuagauuuggaacuuggcccugaucuuaauccuuaccuuucacaucuggcccguauguauaauggauacgcgggcggcauggaggugcaaguuguacuggcuggaaaugcuuuuacugcuggaaagaucauuuuugcugcugucccaccgaacuucccagcggagaaucucagugcagcgcaggucaccauguguccucaugugauaguugauguuaggcaauuagaaccagucaugcuccccaugccugauauuaggaauaaguuauuucacuacaaucaaguugaugacccaaagcuuagauuauuggccuaucuuuacacaccccuccgagcuaacaaugcuggggaugaugucuuuacuguuucuugccgggugcuuacuagaccaaccccagauuuugaguuuauguuuuugguuccccccacuguugaauccaagacuaagcccuuuuccuugccuagucucacccuugaugaacuuuccaauucuagauuuccugcucccauagugcagcuuuauacaaauccucaugauaauuugguugugcagccccagaauggaagguguaccauagauggccuuuugcagggcaccacacagcuuguguccuguaauguuugcaguuuuagagggaccaucggugauggccagccagcaagccacagugaggaagaaauuaugcccauggcuuuuaacauccagcgugagaucaugcuggagaaccuugauggcucgcccuaugacccagcugaugacauccccgcaguccugggcucccccgacuuucaggggaucguguucgggguucucagucagaggaacgcugauggacagaccagagcacaugaagcuaagguggacacuagggcagcccgauucgcccccaaacuuggcuuugucguagccaccguggagagcacagacuuccacgcuaaucaacccaguagguucacuccuguugggcuagguggagauggaaaccaggauuuuaaccagugggcauugccggccuacgguggugcacuaacaaacaacaccaaccuugccccaccugugaugcccgucuacccaggggagcagauacucuacuuccgcucucaguugccaagcucuggcggugugguugguggguggcuggacugucuacucccccaggaauggguccaacauuucuuccaagagucagccaccucccagagugauguggcccugguuagauauauaaaucccaccacagguagagugcucuuugaagcgaaacugcacaaacagggcuuucucaccguggccgccucggguuccuaccccuugguuguucccgcugaugguuauuuuagauuugagucuugggugaaucaauuuuacacuuuggcccccaugggaaaugguagcgggcgcaggagaacucguuaa

SEQ ID NO: 5959 - RNA, 1674 nt, Artificial Sequence
  capsid_protein__Norovirus__AAX32877
augaugauggcaucgaaugaugcuaccgcuccgacugauggagcugccggucucgucccagaggucaccaaugagaccauggcacuggaacccgucgcaggggcggccuuggccgcgccugucguagggcagcauaacguuauugaccccuggauuagagguaauuuugugcaagccccuaauggagaauuuacaguuuccccccguaauuccccuggagagguuuuacuaaauuuggaauuaggcccugaauuaaacccuuaucuggcucaucuugcccguauguacaacggguacgcugguggaauggagguucagguggugcucgcugggaaugcguucgcagcggggaaaaucaucuuugcugccguuccaccaaguuucccaguugaugcuuugagugcgcccacgauaacaaugugcccccacguuauaguggaugugagacaacuggagccaguauugcucccuaugccagauguuaggaauaauuucuuucauuauaaccagaguucugaccccaagcuucgauugguugcaaugcuuuauacgcccuugagagccaauagcccaacugaugauguguuuacugugucuuguagaguucuuacgaggccauccccugauuuugaguucaccuuuuugauaccacccacaguugaguccaaaagcaagccuuuuaccauuccccagcuuaccuugucugaguugucuaauucaagauuuccugcacccauugauaugcuuuauacuagucccaaugauaacauuguggugcagccccagaauggaagaugcacacuugauggugaacuacaaggcacaacccagcuccaaccaagccuuaucugcuccuuucgaggagugacccucaaugagacuucccggauguugguugaucaagaggaagaggaagagggggagguucagcgcccacaagcccgcgccuucaaccaugaauaccaucuucagcugcaaaauuuagauggcacugacuaugacccugcaggggaucuccccgcaaccuuaggggcaccugacuuuauugggacaguguauggagugguuagucagcgcaccacccgugauagugcagcuagggcacaugaggccaaaaucaccacuagugaccccagguaugcucccaagcuuggaucaguugaguucguaacagagucaacagauauugugcugaaugaccagaccaaguuuaccccuguuggucuugcccauaaccgggcaguugacuacaagcagugggagcugccgcauuaugcaggggagcucacagccaacaccaauuuagccccuccuguggcgccuguuuaccccggugaacaauugcuuuucuuccgcucaaaccuuccccuugcaggugguacagccgcaaguguucuugauugucuuuugccccaagaguggauucaacauuuuuaucaggaaucauucgccccccagucugacauugcacuccugagguaugugaaccccgacacagguagaguccucuuugaagcaaaauugcaccgacaggguuacauaacuguggcuggugcuggcaccaguccuguggccgugccuccaaacggcuauuuuagguuugagucuuggguaucacaguuuuacacacuagcccccaugggaucuggaacggggcgcaggaggaaucaguaa

SEQ ID NO: 5960 - RNA, 1674 nt, Artificial Sequence
  capsid_protein__Norovirus__AAX32880
augaugauggcaucgaaugaugcuaccgcuccgacugauggagcugccggucucgucccagaggucaccaaugagaccauggcacuggaacccgucgcaggggcggccuuggccgcgccugucguagggcagcauaacguuauugaccccuggauuagagguaauuuugugcaagccccuaauggagaauuuacaguuuccccccguaauuccccuggagagguuuuacuaaauuuggaauuaggcccugaauuaaacccuuaucuggcucaucuugcccguauguacaacggguacgcugguggaauggagguucagguggugcucgcugggaaugcguucgcagcggggaaaaucaucuuugcugccguuccaccaaguuucccaguugaugcuuugagcgcgcccacgauaacaaugugcccccacguuauaguggaugugagacaacuggagccaguauugcucccuaugccagauguuaggaauaauuucuuucauuauaaccagaguucugaccccaagcuucgauugguugcaaugcuuuauacgcccuugagagccaauagcccaacugaugauguguuuacugugucuuguagaguucuuacgaggccauccccugauuuugaguucaccuuuuugauaccacccacaguugaguccaaaagcaagccuuuuaccauuccccagcuuaccuugucugaguugucuaauucaagauuuccugcacccauugauaugcuuuauacuagucccaaugauaacauuguggugcagccccagaauggaagaugcacacuugguggugaacuacaaggcacaacccagcuccaaccaagccuuaucugcuccuuucgaggagugacccucaaugagacuucccggauguugguugaucaagaggaagaggaagagggggagguucagcgcccacaagcccgcgccuucaaccaugaauaccaucuucagcugcaaaauuuagauggcacugacuaugacccugcaggggaucuccccgcaaccuuaggggcaccugacuuuauugggacaguguauggagugguuagucagcgcaccacccgugauagugcagcuagggcacaugaggccaaaaucaccacuagugaccccagguaugcucccaagcuuggaucaguugaguucguaacagagucaacagauauugugcugaaugaccagaccaaguuuaccccuguuggucuugcccauaaccgggcaguugacuacaagcagugggagcugccacauuaugcaggggagcucacagccaacaccaauuuagccccuccuguggcgccuguuuaccccggugaacaauugcuuuucuuccgcucaaaccuuccccuugcaggugguacagccgcaaguguucuugauugucuuuugccccaagaguggauucaacauuuuuaucaggaaucauucgccccccagucugacauugcacuccugagguaugugaaccccgacacagguagaguucucuuugaagcaaaauugcaccgacaggguuacauaacuguggcuggugcuggcaccaguccuguggccgugccuccaaacggcuauuuuagguuugagucuuggguaucacaguuuuauacacuagcccccaugggaucuggaacggggcgcaggaggaaucaguaa

SEQ ID NO: 5961 - RNA, 1647 nt, Artificial Sequence
  capsid_protein__Norovirus__AAX32886
augaagauggcgucuagugacgcugcuccaucuagugauggcagugccggucucguaccagaggucaacagugagaccauggcccuggaacccguggugggugcuccccuugccgcacccguugcgggacaacauaacauaauugaccccuggauuaaguuaaauuuuguucaagccccuaauggugaauuuacaguguccccccguaaugccccgggugaaauucuuuuagauuuggagcuaggaccugaccugaaucccuauuuggcccauuuguccagaauguauaaugcauaugcaggggguauggaagugcaaguuauuuuggcagguaaugcuuuuacggcagggaaaauuauuuucgcugcggugccacccaauuuuccccuugaaaauuugagugcagcccaaauuaccaugugcccccacauuauaguugaugugagacaauuagaaccaguuaugcuccccaugccugaugugaggaauaggcuuuuucacuauaaucaagucagggaaccuagacucagauugguggccuaucucuacacgcccuugagagcaaauaacgcgggugaugacguuuuuacagucucgugccgcguuuugaccaggccaucacaggauuuugaguuuauguuuuuggucccuccuucaguugagucuaagacuaagcccuuuucccuccccaaccuuacccuagcugagcuuucuaauucuagauuucccuugcccauagaacaacuuuauacaaauccccuugauaauuuggugguucagccgcagaaugggaggugcaccaucgaugggauuuuacuugggacgacacagcugguuccuucauugauuuguucgaugagggguaccuuggaggcagaccaagcaucggggcacacugaugacgagagugugcagucgcgugcguucaaccgccaacgaagccuuauguuggagaacccugacgggucggcuuuugacccaucggaugaaguccccgcggugcuuggugucccagacuuccgcgggguuguuuuugguguccucagccagagaaauaacggcgacaccaccagaucgcaugaggccaagauugacacgcgccgaccacgcuaugcucccaagcuggguuuugucgaggugcucacugagagugaugauuuccaaaacggaccucccacaaaauuuacaccgguuggccuggggggggauggcaauccggauuuccaacagugggcccucccugauuauggcggugcauugaccaacaauaccaaccuugcuccacccguugugcccguguacccaggugaacaaauucuuuucuuucgcucccaacuuccaagcucaggugguacaguugcuggguggcuugauugucuccuaccucaagaguggauccagcauuuuuaccaggacucugcagcagcucagagugacguggccuugguuagauacaucaaccccgccacaggcaggguccuuuuugaggccaagcuccaccgacaaggcuuuuugaccgugucagccgccgggccccaucccguaguggcaccagcugauggcuauuuuagguucgaguccugggugaaucaauuuuacacuuuggcccccaugggaaauggaagugggcguaggaggguuuauuaa

SEQ ID NO: 5962 - RNA, 1623 nt, Artificial Sequence
  capsid_protein__Norovirus__AAZ31376
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccgggaaaaucauauuugcagcagucccaccaaacuucccaacugaagucuugagccccagccaggucacuauguucccccauauaauaguagauguuaggcaacuggaaccuguguugaucccccugccugauguuaggaauaaucucuaucauuacaaucaaucaaaugaccccaccaucagauugauagcaaugcuguauacaccacuuagggcuaacaaugcuggggacgaugucuucacagucucuugucgaguucucacgagaccaucccccgauuuugauuucauguuuuuggugccacccacaguugagucaagaacuaaaccauucucugucccaaucuuaacuguugaggagaugaccaauucaagauuccccauuccuuuggaaaaguuguucacgggucccagcagugccuuuguuguucaaccacaaaauggcagaugcacgacugauggcgugcucuuggguacuacucaacugucuccugucaacaucugcaccuucagaggggaugucacccacauugcaggugcucaaaauuacacaaugaaucuggccucccaaaauuggaacaauuaugacccaacagaagaaaucccagccccucugggaaccccagauuuuguaggaaagauccaaggcgugcucacccaaaccacaaggagggauggcucgacccgcggucacaaagccacagugagcacuggaaguguccacuuuaccccaaagcugggcaguguucaauucucuacugauacaagcaaugacuuugaaacuggccaaaacacgagauucaccccagucggugucguccaggaugguaguaccacccaccaaaaugaaccccaacaaugggugcucccagacuauucagguagagauagucacaauguacaccuagccccugccguggcccccacuuuuccgggcgagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguuuuguuugagugcaagcuucauaaaucaggcuauguaacaguggcucacacuggccaacaugauuugguuaucccccccaauggcuauuuuagauuugauuccuggaucaaccaauucuacacacuugcccccaugggaaauggagcggggcguagacgugcauuauaa

SEQ ID NO: 5963 - RNA, 1623 nt, Artificial Sequence
  capsid_protein__Norovirus__AAZ31396
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccgggaaaaucauauuugcagcagucccaccaaacuucccaacugaagucuugagccccagccaggucacuauguucccccauauaauaguagauguuaggcaacuggaaccuguguugaucccccugccugauguuaggaauaaucucuaucauuacaaucaaucaaaugaccccaccaucagauugauagcaaugcuguauacaccacuuagggcuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagauuccccauuccuuuggaaaaguuguucacgggucccagcagugccuuuguuguucaaccacaaaauggcagaugcacgacugauggcgugcucuuagguacuacccaacugucuccugucaacaucugcaccuucagaggggaugucacccacauugcagguacucaaaauuacacaaugaaucuggccucccaaaauuggaacaauuaugacccaacagaagaaaucccagccccucugggaaccccagauuuuguaggaaggauccaaggcgugcucacccaaaccacaaggagggauggcucgacccgcggucacaaagccacagugagcacuggaaguguccacuuuaccccaaagcugggcaguguucaauucuccacugauacaagcaaugacuuugaaacuggccaaaacacgagauucaccccagucggugucguccaggaugguaguaccacccaccaaaaugaaccccaacaaugggugcucccagacuauucagguagagauagucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacaggcaggguuuuguuugagugcaagcuucauaaaucaggcuauguaacaguggcucacacuggccaacaugauuugguuaucccccccaauggcuauuucagauuugauuccugggucaaccaauucuacacacuugcccccaugggaaauggagcggggcguagacgugcauuauaa

SEQ ID NO: 5964 - RNA, 1623 nt, Artificial Sequence
  capsid_protein__Norovirus__AAZ31402
augaagauggcgucgaaugacgccagcccaucugauggguccacagccaaccucgucccagaggucaacaaugagguuauggcuuuggagcccguuguuggugccgcaauugcggcacccguagcgggccaacaaaauguaauugaccccuggauuagaaauaauuuuguacaagccccugguggagaguucacaguauccccuagaaacgcuccaggugaaauacuauggagcgcgcccuugggcccugaucugaaucccuaccuuucucauuuggccagaauguacaaugguuaugcagguggcuuugaagugcagguaauucucgcggggaacgcguucaccgcugggaaaaucauauuugcagcagucccaccgaauuuuccaacugaaggcuugggccccagccaggucaccauguucccccauauaauaguagauguuagacaacuggaaccuguguugauccccuuacuugauguuaggaauaaucucuaucacuauaaucagucaaaugacccuaccaucaaacugauagcaaugcuguacacaccacuuagggcuaauaaugcuggugaaguugucuucacagucucuugccgaguccucacgaggccaucccccgauuuugauuucauauuuuuggugccacccacaguugagucaagaacuaaaccauucaccgucccaauuuuaacugcugaggaaaugaccaauucaagauuccccacuccuuugggaaaguuguucacgggucccagcagugccuuuguuguucaaccacaaaauggcagaugcgcgacugauggcgugcucuuaggcacuacccaacugucuccugucaacaucugcaccuucagaggggaugucacccacauugcagguacucaugauuacacaaugaauuuggcuucccaaaauuggaacaauuaugacccaacagaagaaaucccagccccucugggaacuccagauuucgugggaaagauccaaggcgugcucacucaaaccacaaggggagauggcucgacccguggccacaaagcuacagugagcacugggaguguccacuuuacuccaaagcugggcgguguucaauucaccacugauacaaauaaugauuuugaaacuggccaaaacacgaaauucaccccagucggugucauccaggauggcaauagcacccaccaaaaugaaccccaacaaugggugcucccaaauuacucagguagaacuggccauaauguacaccuagccccugcuguagcccccacuuuuccgggugagcaacuucuuuucuucagguccacuaugcccggaugcagcggguaucccaacaugaauuuggauugccuacucccccaggaaugggugcagcacuucuaccaagaggcagcuccagcacaaucugauguggcucugcugagauuugugaauccagacgcagguaggguccuguuugagugcaaaccucauaaaucaggcuaugucacaguggcucacacuggccagcaugauuugguuaucccccccaauggcuauuuuagauuugauuccuggguuaaccaauucugcacacuugcccccaugggaaauggaacggggcguagacgugcauuauaa

SEQ ID NO: 5965 - RNA, 1620 nt, Artificial Sequence
  capsid_protein__Norovirus__AAZ31411
augaagauggcgucgaaugacgccaacccaucugauggguccgcagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccgggugagauauuauggagcgcgcccuugggcccugauuugaaccccuacccuucucauuuggccagaauguacaaugguuaugcgggugguuuugaagugcaaguaauccucgcggggaaugcguucaccgccgggaaaaucauauuugcagcagucccaccaaauuuuccaacugaaggcuugagccccagccagguuacuauguucccccauauaauaguagauguuaggcaauuggauccuguguugauccccucaccugauguuaggaauaacuucuaucauuacaaucaaucaaaugauucuaccauuaaauugauagcaaugcuguauacaccacuuagggcuaauaaugcuggggaugaugucuucacagucucuugucgaguccucacgaggccaucccccgauuuugauuucauauucuuggugccacccacaguugaaucaagaacuaaaccauucaccgucccaaucuuaacuguugaggaaaugucuaacucaagauuccccauuccuuuggaaaaguuguacacgggucccagcagugcuuuuguuguccaaccacaaaauggcaggugcacgacugauggcgugcucuuaggcacuacccagcugucugcugucaacaucugcaccuucagaggggaugucacccacauugcagguagucaugacuauacaaugaauuuggcuucucaaaauuggaucaauuaugacccaacagaagaaaucccagccccucugggaacuccagauuucgugggaaagauccaaggcaugcucacccaaaccacaagggaggacggcucgacccgcgcccacaaagcuacagugagcacugggaguguccacuucacuccaaagcugggcaguguucaauacaccacugacacaaacaaugacuuucaaacuggccaagacacgaaauucaccccggucggcgucauccaggacgguaauaaucaucaaaaugaaccccaacaaugggugcucccaaauuacucagguagaacaggucauaaugugcaccuagcuccugccguugcccccacuuucccgggcgagcaacuucuuuucuucagguccacuaugcccggauguagcggguauccuaacaugaaucuggauugccuacuuccccaagaaugggugcaacacuucuaccaagaagcagcuccagcacaaccugauguggcucugcugagauuugugaauccagacacagguaggguuuuguuugagugcaagcuccauaaaucaggcuaugucacaguggcucacacuggcccgcaugauuugguuaucccccccaaugguuauuuuagauuugacuccugggucaaccaguucuacacacuugcccccaugggaaauggagcggggcgcagacgugcauuauaa

SEQ ID NO: 5966 - RNA, 1647 nt, Artificial Sequence
  capsid_protein__Norovirus__AAZ31423
augaagauggcgucgagugacgccacuccaucuaaugauggugccgccggccucgucccagagaucgacaaugaggcaauggcgcuagauccaguggcgggugcagcgauagcagcaccccucacuggucagcaaaauauaauugaucucuggauuaugaauaauuuugugcaagcaccugguggugaguuuacaguauccccuagaaauuccccuggugaagugcuucuuaauuuggaauugggcccagaaauaaaucccuauuuggcucaucuugcuagaaugcauaaugguuaugcagguggauuugaagugcagguaguccuagcuggaaaugcguuuacagcaggaaagauaaucuuugcagcuauacccccuaauuuuccaauugauaauuugagugcagcacagaucacaaugugcccacaugugauuguggaugucagacaguuggaaccggucaaccucccgaugccugacguucgcaacaacuucuuucauuauaaucaagggucugauucgagauugcgcuuaauugcaaugcuguauacaccucuuagggcaaauaauucuggggaugauguuuucacugugucuuguagagugcugacuaggccuagcccugacuuuucauuuaauuuccuugugccaccuacuguggagucaaagacaaaacccuucacccucccuauucugacuaucuccgaaauguccaauucuagguuuccagugccgauugauucuuugcucaccagcccaacugagaauauuguuguccagugccaaaaugggcgcgucacucuugauggugaguugaugggcaccacccaacucuuaccuagucaaauuugugcuuuuaggggcgugcucaccagaucaacaagcagggccagugaccaagccgacacagcaaccccuagauuguuuaauuacuauuggcacauacaauuggauaaucuaaaugggaccccuuaugacccugcagaagacauaccaggcccccuagggacaccagauuuucggggcaaggucuuuggcguggccagccagagaaaucccgacagcacaacuagagcacaugaggcaaagguggacacaacagcuggucguuucaccccaaaacuaggcucauuagagauauccacugaaucugaugacuuugaucaaaaccaaccaacaagauucaccccaguuggcauugggguugaccgugaggcagacuuucaacaauggucuuuacccgacuauucuggucaguucacccacaacaugaacuuagccccagcuguugcucccaaccuuccuggugaacagcuccuuuucuuccgcucgcagcuaccauccucuggugggcgauccaccgggauucuagacugccuggucccccaagaauggguucagcacuucuaccaagaaucggcccccgcccaaacucaaguggcccugguuagguauaucaacccugacacugguagaguauuauuugaggccaagcugcacaaauuagguuucaugacuauagcuaagaauggugacucuccaauaacugucccuccaaauggguacuuuagguuugaaucuugggugaaccccuuuuauacacuugcccccaugggaacugggagugggcguagaaggauucaauaa

SEQ ID NO: 5967 - RNA, 1623 nt, Artificial Sequence
  capsid_protein__Norovirus__AAZ31428
augaagauggcgucgaaugacgcagcuccaucuaaugauggugcagcaggccucguaccagagaucaacaaugaggucaugccccuugagcccguggcuggugcaucgcuggcgacaccaguagucgggcaacaaaacauaauugaucccuggauaagaaauaauuuugugcaagcuccugcaggugaguuuacagucuccccuagaaauuccccuggugaaaucuugcuugacuuggaguugggaccagaauugaaccccuaucucgcucaucuggcccguauguauaaugggcacccuucuggcauggaagagcaaauuguguuggcugggaacgcguucacagcuggcaagaucauauuugccgccaucccuccaggguucccauaugaaaauuugucaccuucacauaugaccaugugcccccauguuauaauuuauguuauacaauuagaaccaguucuaaugcuuaugccagagauucaaaacaacuucuuccauuauaaucaggggaaugauccaaaauugagauugguagcuaugcucuauaccccuuuaagggcuaauaauucuggugaugauguguuuacagucucuuguaggguccuuacuaaaccgucaccugauuuugaauucacauuucugguucccccuacaguugaauccaaaaccaaagaguuuacauuacccauucuaagaauaucagagaugaccaauucaagauucccagugccaguggaaaugauguacacagcuaggaaugagaaccaaguuguccagccacagaaugguagggucacgcucgauggugagcuauugggcaccacacccuuguuggcugucaacauaugcaaauucaagggagagguuauagcuaagaauggagaugugagaucuuauagaauggacauggaaauuaccaacacugauggcaccccaauugaccccacagaagacacaccuggucccauugguucaccugauuuccaaggcauacucuuuggcguugccagccaacgcaacaagaaugagcaaaaccccgccacgagagcccaugaaguuaauauuaacacugguggggaccaauaugccccuaaauuggcccaagugaaauucuucucggaaucccaggauuuugaggugcaucagcccacaguuuucaccccaguugguguggcaggcgacacuucucacccuuucagacaguggguccuaccucgauacgguggacaucucaccaauaacacccacuuggcuccagcaguggccccucuauucccaggugagcagauuuuauucuucagaucacaaauaccuagcucaggcggccaugaauugggcuacauggacugccuugucccacaagagugggugcaacacuuuuaucaagaagcugccacagcucagucugagguggcucucauaagguucauuaacccagacacugguagaguccucuuugaggcuaagcugcauaagcaaggcuuuauaacuguggcucacacuggugauaacccaauugucaugccaccaaauggguacuuuagauuugaagccuggguuaaucaguuuuacucacucgccccugugggaacugggaaugggcgcaggaggguccaauaa

SEQ ID NO: 5968 - RNA, 1626 nt, Artificial Sequence
  capsid_protein__Norovirus__ABB02420
augaggaugagugauggcgcagcgccaaaagccaacggcucugaagccagcggccaggaucuuguuccuaccgccguugaacaggccguccccauucagcccguggcuggcgcggcucuugccgcccccgccgccgggcaaauuaaccaaauugaccccuggaucuuccaaaauuuuguccaaugcccccuuggugaguuuuccauuucaccucgaaacaccccaggugaaauacuguuugauuuggcccucggaccggggcucaaccccuaccucgcccaccucucagccauguacaccggcuggguugggaacauggagguucagcugguccucgccggcaaugccuuuacugcuggcaaggugguuguugcccuuguaccacccuauuuucccaaagggucacucaccacugcucagaucacaugcuucccacaugucaugugugaugugcgcacccuggagcccauucaacucccucuucuugacgugcgucgaguucuuuggcaugcuacccaggaucaggaggaaucuaugcgccugguuugcauguuguacacgccacuccgcacaaacagcccgggugaugagucuuuuguggucucuggccgccuucuuucuaagccggcggcugauuucaacuuuguauaccugaccccccccaucgagaggaccaucuaccgaauggucgaccugcccguguugcagccgcggcugugcacgcacgcucguuggccagccccggucuauggccucuugguugacccgucccucccguccaacccccaauggcagaauggaagagugcacguugauggaacccuucuuggcacaacaccugucucugguuccuggguuuccugcuuugcagcagaagccgccuacgaguuccagucugggacuggucagguggcgaccuucaccaugauugagcaggacgggucugccuacgucccuggugacagggcggccccccuuggcuaccccgauuacuccgggcaacuggagauugaggugcagacugagaccaccaaagcaggugacaagcugaaagugaccaccuuugagaugauccuuggucccacuaccaacguggaccaggcucccuaccaggguagagcguaugcgagcuuaacggcuguagccucacucgaccugguagacgggaggguuagggcagucccccgcucuaucuacuccuuccaggacgugcucccagaguacaaugauggucuuuugguuccccuugccccaccccugggucccuuccuucccggugaggucuuguugagguuccgaaccuacaugcgccagcuugacaccgcugacgcugcggcgcagccgauugacugugccuugccccaggaguuuaucuccugguucgcaagcaacagcuucacgguccagucggacgcgcuccugguuagguaccggaacaccuugaccggccagcuccuguucgaggcuaagcucuauagugaaggcuacauugcugugucuuauucaggaucuggcccccucaccuuuccuaccgacggcuucuucgaggucguuaguugggucccccgccucuuucaauuggccucugugggaagcuuggcaacaggccgaacacucaaacaauaa

SEQ ID NO: 5969 - RNA, 1626 nt, Artificial Sequence
  capsid_protein__Norovirus__ABB02423
augaggaugagugauggcgcagcgccaaaagccaacggcucugaagccagcggccaggaucuuguuccuaccgccguugaacaggccguccccauucagcccguggcuggugcggcucuugccgcccccgccgcugggcaaaucaaccaaauugaccccuggaucuuccaaaauuuuguccaaugcccccuuggugaguuuuccauuucaccucgaaacaccccaggugaaauacuguuugauuuggcccucgggccagggcucaaccccuaccuugcccaccucucggccauguacaccggcuggguugggaacauggagguucagcugguccucgccggcaaugccuuuacugcuggcaaggugguuguugcccuuguaccacccuauuuucccaaagggucacucaccacugcucagaucacaugcuucccacaugucaugugugaugugcgcacccuggagcccauucaacucccucuucuugacgugcgucgaguucuuuggcaugcuacccaggaccaggaggaaucuaugcgccugguuugcaugcuguacacgccacuccgcacaaacagcccgggugaugagucuuuuguggucucuggccgccuucuuucuaagccggcaucugauuucaacuuuguauaccugaccccccccaucgagagaaccauuuaccggaugguugacuugcccguguugcagccgcggcugugcacgcacgcucguuggccggccccggucuauggccucuugguagacccaucccuuccauccaacccccaguggcagaaugguagaguacauguugaugggacucuucuugguacaacaccugugucuggcucuuggguuuccugcuucgcagcugaggccgccuacgaguuccagucugggacuggugagguggcgaccuucaccaugauugagcaggacggguccgcuuacgucccuggcgacagggcggccccccucggguaccccgacuucuccgggcaacuggagaucgaggugcagacugagaccaccaagacgggcgacaaacucaaggugaccaccuuugagaugauccugggccccaccaccaacguggaccaggcccccuaccagggcagggcguacgcgagccugacggcugcggccucgcucgaccugguggaugggagaguuagggcggucccgcgcuccgucuacucuuuccaagacgagcucccagaauauaaugauggucuuuugguuccccuugccccaccccuaggucccuuccuuccuggugagguucuguugagguuucgcaccuacaugcgccagcucgauaccgcugacgccucagcgcaaccgaucgacugugccuugccccaggaguucaucuccugguuugcaagcaacaacuucacaguccagucggacgcgcuccugguuagguaccggaacaccuuaaccggucagcuucuguuugaggcuaagcuuuauagugaaggcuauauugcuguguccuauucagggucuggcccccucaccuuccccacugacggcuucuuugagguugucaguugggucccccgccucuuucaauuggccucugugggaagcuuggugacaggccgaacacucaaacaauaa

SEQ ID NO: 5970 - RNA, 1623 nt, Artificial Sequence
  capsid_protein__Norovirus__ABC96746
augaagauggcgucgaaugacgccagcucaucugaugggucuacagcaaaccucgucccagaggucaacaaugagguuauggcuuuggagcccguuguuggugccgcaauugcggcaccuguagcgggccaacaaaauguaauugaccccuggauuagaaauaauuuuguacaagccccugguggagaguucacaguauccccuagaaacgcuccaggugaaauacuauggagcgcgcccuugggcccugaucugaaucccuaccuuucucauuuggcccgaauguacaaugguuaugcaggugguuuugaagugcagguaauccucgcggggaacgcguucaccgccgguaaaaucauauuugcagcagucccaccaaauuuuccaacugaaggcuugagccccagccaggucaccauguucccccauauaauaguagauguuagacaacuggaaccuguguugauccccuuaccugauguuaggaauaauuucuaccacuauaaucagucaaaugacccuaccauuaaacugauagcaaugcuauacacaccacuuagggcuaauaaugcuggggaugaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauuccccauuccuuuggaaaaguuguucacgggucccagcagugccuuuguuguccaaccacaaaauggcagaugcacgacugacggcgugcucuuaggcacuacccaacugucuccugucaacaucugcaccuucagaggggaugucacccacauugcagguacucaugauuacacaaugaauuuggcuucucaaaauuggaacaauuacgacccaacagaagaaaucccagccccucugggaacuccagauuucgugggaaagauccaaggcgugcucacucaaaccacaaggggagacggcucaacccguggccacaaagcuacagugagcacugggaguguccacuuuacuccaaagcugggcaguguucaauucaccacugauacaaacaaugauuuugaaacuggccaaaacacgaaauucaccccagucggugucguccaggauggcaauaguacccaccaaaaugaaccccaacaaugggugcucccaaauuacucaggcagaacuggccacaauguacaccuagccccugccguagcccccacuuuuccgggugagcaacuucuuuucuucagguccacuaugcccgguugcagcggguaucccaacaugaauuuggauugccuacucccccaggaaugggugcagcacuucuaccaagaggcagcuccagcacaaucugauguggcucugcugagauuugugaauccagacacagguaggguccuguuugagugcaaacuucauaaaucaggcuaugucacaguggcucacacuggccagcaugauuugguuaucccccccaauggcuauuuuagauuugauuccuggguuaaccaauucuacacacuugcccccaugggaaauggagcggggcguagacgugcguuauaa

SEQ ID NO: 5971 - RNA, 1620 nt, Artificial Sequence
  capsid_protein__Norovirus__ABD77588
augaagauggcgucgaaugacgccagcccaucugauggguccacagccaaccucgucccagaggucaacaaugagguuauggcuuuggagcccguuguuggugccgcuauugcggcaccuguagcgggccaacagaauguaauugaccccuggauuaggaauaguucuguacaagccccugguggagaguucacaguauccccuagagacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagccccaccaaauuucccaacugaaggcuugagccccagccaggucacuauguucccccacauaauaguagguguuaggcaauuggaaccuguguugauccccuuaccugauguuaggaauaauuucuaccauuacaaucaaucaaaugacuccaccauuaaauugauagcaaugcuguacacaccacucagagcuaauaaugcuggggaugaugucuucacagucucuugucgaguccucacgaggccaucccccgauuuugauuucauauuucuggugccacccacaguugagucaagaaccaaaccauucaccgucccaauuuuaacuguugaggaaaugaccaauucaagauuccccauuccuuuggaaaauuguucacgggucccagcagugccuuugucguccaaccacaaaaugcagugcacgacugauggcgugcucuuaggcacuacccagcugucccccgucaacaucugcaccuucagaggcgaugucacccacauuccagguacucguacuuacagaaugaauuuggcuucucaaaauuggaacaauuaugacccaacagaagaaaucccagccccucugggaacuccagauuucguaggaaagauccaaggcaugcucacccaaaccacaaagggagacggcucgacccgcggccacaaagcuacagugagcacugggaguguugacuuuacuccaaagcugggcagcguucaguucgccacugauacagacaaugauuuugaaacuggccaaaacacaagguucaccccagucggugucauccaggaugguaguaguacccacagaaaugaaccccaacaauggguacucccagauuacucagguagaacuguucauaauguacaccuggccccugccguagcccccacuuuuccgggugagcaacuucuuuucuucagaucuacuaugcccggaugcaguggguaccccaauauggauuuggauugucuacucccccaggaaugggugcagcacuucuaccaagaggcagccccaucacaaucugauguggcuuuguugagauuugugaauccagacacagguaggguucuguuugagugcaagcuucauaaagcaggcuaugucacaguggcucacacuggccagcaugauuugguuaucccccccaauggcuacuuuagauuugauuccugggucaaccaguucuacacacuugcccccaugggaaauggagcggggcguagacgugcauuauaa

SEQ ID NO: 5972 - RNA, 1623 nt, Artificial Sequence
  capsid_protein__Norovirus__ABD77589
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuaggaauaauuuuguacaagccccugguggagaguucacaguauccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccacauaauaguagauguuaggcaauuggaaccuguguugauccccuuaccugauguuaggaauaauuucuaccauuacaaucaaucaaaugacuccaccauuaaauugauagcaaugcuguacacaccacuuagggcuaauaaugcuggggaugaugucuucacagucucuugucgaguccucacgaggccaucccccgauuuugauuucauauuucuggugccacccacaguugagucaagaaccaaaccauucaccgucccaauuuuaacuguugaggaaaugaccaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggcgaugucacccacauuccagguacucguacuuacagaaugaauuuggcuucucaaaauuggaacaauuaugacccaacagaagaaaucccagccccucugggaacuccagauuucgugggaaagauccaaggcaugcucacccaaaccacgaagggagacggcucgacccgcggucacaaagccacagugagcacugggaguguugacuuuacuccaaagcuggacagcguucaguucgccacugauacagacaaugauuuugaaacuggccaaaacacaagguucaccccagucggugucauccaggaugguaguagugcccacagaaaugaaccccaacaauggguacucccagauuacucagguagaacuguucacaaugugcaccuagccccugccguagcccccacuuuuccgggugagcaacuucuuuucuucagaucuacuaugcccggaugcaguggguaucccaauauggauuuggauugucuacucccccaggaaugggugcagcacuucuaccaagaggcagccccaucacaaucugauguggcuuugcugagauuugugaauccagacacagguaggguccuguuugagugcaagcuucauaaagcaggcuaugucacaguggcucacacuggccagcaugauuugguuaucccccccaauggcuacuuuagauuugauuccugggucaaccaguucuacacacuugcccccaugggaaauggagcggggcguagacgugcauuauaa

SEQ ID NO: 5973 - RNA, 1647 nt, Artificial Sequence
  capsid_protein__Norovirus__ABD77590
augaagauggcgucgaaugacgccacuccaucuaaugauggugccgccggccucgucccagagaucaacaaugaggcaauggcgcuagauccaguggcgggugcagcgauagcagcaccccucacuggucagcaaaauauaauugaccccuggauuaugaauaauuuugugcaagcaccugguggugaguuuacaguauccccuaggaauuccccuggugaagugcuucucaauuuggaauugggcccagaaauaaaucccuauuuggcccaucuugcuagaauguauaaugguuaugcagguggguuugaagugcagguaguccuagcuggaaaugcguuuacagcaggaaagauaaucuuugcagcuauacccccuaauuucccaauugauaaucuaagcgcagcacagaucacaaugugcccacaugugauuguggaugucagacaguuggaaccggucaaccuuccgaugccugacguucgcaauaacuucuuccauuacaaccaagggucugauucgaaauugcgcuuaguugcaaugcuguauacaccucuuagggcaaauaauucuggggaugauguuuuuacugugucuuguagagugcugaccaggccuagcccugacuuuucauuuaauuuccuugugccaccuacuguggagucaaagacaaaacccuucacccuaccuauucugacuaucucugaaauguccaauucuagguuuccagugccgauugauucucugcacaccagcccaacugagaauauuaguguccagugccaaaauggacgcgucacucuugauggugaguugaugggcaccacccaacucuuaccuagucaaaucugugcuuuuaggggcgugcucaccagaucaacaagcagggccagugaccaggccgacacagcaaccccuagguuguuuaauuauuauuggcacauacaauuggauaaucuaaaugggacuccuuaugacccugcagaagacauaccaggcccccuagggacaccagauuuccggggcaaagucuuuggcguggccagccagagaaaucccgacagcacaacuagagcacaugaagcaaagguggacacaacagcuggucguuuuaccccaaaacuaggcucauuagagauauccacugaaucuggugacuuugaucaaaaccaaccaacaagauucaccccaguugguauugggguugaccacgaggaaaauuuccaacaauggucuuuacccgacuauucuggucaguucacccacaacaugaauuuagccccagcuguugcucccaacuucccuggugagcagcuucuuuucuuccgcucacaguuaccaucuucuggugggcgauccaacgggauucuagacugccuggucccccaagaauggguucagcacuucuaccaagaaucggcccccgcccaaacucaaguggcccugguuagguaugucaacccugacacugguagaguguuguuugaggccaagcugcacaaauuagguuucaugacuauagcuaagaauggugacucuccaauaacuguccccccaaauggauacuuuagguuugaaucuugggugaacccauuuuauacacuugcccccaugggaacugggaaugggcguagaaggauucaauaa

SEQ ID NO: 5974 - RNA, 1626 nt, Artificial Sequence
  capsid_protein__Norovirus__ABG45845
augaggaugagugauggcgcagcgccaaaagccaacggcucugaagccagcggccaggaucuuguuccuaccgccguugaacaggccguccccauucagcccguggcuggugcgucucuugccgcccccgccgccgggcaaauuaaccaaauugaccccuggaucuuccaaaauuuuguccaaugcccccuuggugaguuuuccauuucaccucgaaacaccccaggugaaauacucuuugauuuggcccucgggccagggcucaacccuuaccuugcccaccucucagccauguacaccggcuggguugggaacauggagguucagcugguccucgccggcaaugccuuuacugcuggcaaggugguuguugcccuuguaccacccuauuuucccaaagggucacucaccacugcucagaucacaugcuucccacaugucaugugugaugugcgcacccuggagcccauucaacucccucuucuugaugugcgucgaguucuuuggcaugcuacccaagaucaggaggaaucuaugcgccuggucugcaugcuguacacgccacuccgcacaaauagcccgggugaugagucuuuuguggucucuggccgccuucuuucuaagccggcagcugauuucaauuuuguauaccugaccccccccauugagaggaccaucuaucggaugguugacuugcccguguugcaaccgcggcugugcacgcaugcucguuggccagcaccgauuuauggucucuugguggaccccucccucccggcuaacccccaauggcagaauggaagagugcauguugauggaacccuucuugguacaacaccuguuucugggucuugggucuccugcuuugcugcugaggccgccuacgaguuccaaucugggacuggugagguggcgaccuucacccugauugagcaggauggauccgcuuauguccccggcgacagagcggccccccugggcuaccccgacuucucuggacagcuggagauugaggugcagacugagaccaccaagacaggcgacaaguuaacggugaccacuuuugagaugauucuuggucccaccaccaacguggaccaggcgccuuuccaggguagggcauacgcuagcuuaacggcugcggccucccucgaccugguggauggcagaguuagagcggucccgcgcuccaucuauaguuuccaggaugugauucccgaguauaaugauggucuucuuguuccccuugcccccccuauuggccccuuucuucccggcgagguucuucugagguuccggaccuauaugcgccagauugacagcucugacgcugcagcggaagccauugacugcgcccucccacaagaguuuaucucgugguuugcgaguaacgcauucacggugcagucggaggcucugcuccuuagguauaggaacacccugacugggcaauugcuguuugaguguaagcucuacagcgaaggcuauauugcccuguccuauucgggcucaggaccacucaccuucccgacugauggcuucuuugaaguggucagcuggguuccccgucuuuaucaauuggccucugugggaagcuuggcaacgggccggacacucaaacaauaa

SEQ ID NO: 5975 - RNA, 1626 nt, Artificial Sequence
  capsid_protein__Norovirus__ABG45847
augaggaugagugauggcgcagcgccaaaagccaacggcucugaagccagcggccaggaucuuguuccuaccgcccuugaacaggccguccccauucagcccguggcuggugcgucucuugccgcccccgccgccgggcaaauuaaccaaauugaccccuggaucuuccaaaauuuuguccaaugcccccuuggugaguuuuccauuucaccucgaaacaccccaggugaaauacucuuugauuuggcccucgggccagggcucaacccuuaccuugcccaccucucagccauguacaccggcuggguugggaacauggagguucagcugguccucgccggcaaugccuuuacugcuggcaaggugguuguugcccuuguaccacccuauuuucccaaagggucacucaccacugcucagaucacaugcuucccacaugucaugugugaugugcgcacccuggagcccauucaacucccucuucuugaugugcgucgaguucuuuggcaugcuacccaagaucaggaggaaucuaugcgccuggucugcaugcuguauacgccacuccgcacaaauagcccgggugaugagucuuuuguggucucuggccgccuucuuucuaagccagcagcugauuucaauuuuguauaccugaccccccccauugagaggaccaucuaucggaugguugacuugcccguguugcagccgcggcugugcacgcaugcucguuggccagcaccgauuuauggucucuugguggaccccucccucccggcuaacccccaauggcagaauggaagagugcauguugauggaacccuucuugguacaacaccuguuucugggucuugggucuccugcuuugcugcugaggccgccuacgaguuccaaucugggacuggugagguggcggccuucacccugauugagcaggauggauccgcuuauguccccggcgacagagcggccccccugggcuaccccgacuucucuggacagcuggagauugaggugcagacugagaccaccaagacaggcgacaaguuaacggugaccacuuuugagaugauucuuggucccaccaccaacguggaccaggcgccuuuccaggguagaguauacgcuagcuuaacggcugcggccucccucgaccugguggauggcagaguuagagcggucccgcgcuccaucuaugguuuccaggaugugauucccgaguauaaugauggucuucuuguuccccuugcccccccuauuggccccuuucuucccggcgagguucuucugagguuccggaccuauaugcgccagauugacagcucugacgcugcagcggaagccauugacugcgcucucccacaagaguuuaucucgugguuugcgaguaacgcauucacggugcagucggaggcucugcuccuuagguauaggaacacccugacugggcaauugcuguuugaguguaagcucuacagcgaaggcuauauugcccuguccuauucgggcucaggaccacucaccuucccgacugauggcuucuuugaagucgucagcuggguuccccgucuuuaucaauuggccucugugggaagcuuggcaacgggccggacacucaaacaauaa

SEQ ID NO: 5976 - RNA, 1626 nt, Artificial Sequence
  capsid_protein__Norovirus__ABG45849
augaggaugagugauggcgcagcgccaaaagccaacggcucugaagccagcggccaggaucuuguuccuaccgccguugaacaggccguccccauucagcccguggcuggugcgucucuugccgcccccgccgccgggcaaauuaaccaaauugaccccuggaucuuccaaaauuuuguccaaugcccccucggugaguuuuccauuucaccucgaaacaccccaggugaaauacucuuugauuuggcccucgggccagggcucaacccuuaccuugcccaccucucagccauguacaccggcuggguugggaacauggagguucagcugguccucgccggcaaugccuuuacugcuggcaaggugguuguugcccuuguaccacccuauuuucccagagggucacucaccacugcucagaucacaugcuucccacaugucaugugugaugugcgcacccuggagcccauucaacucccucuucuugaugugcgucgaguucuuuggcaugcuacccaagaucaggaggaaucuaugcgccuggucugcaugcuguacacgccacuccgcacaaauagcccgggugaugagucuuuuguggucucuggccgccuucuuucuaagccagcagcugauuucaauuuuguauaccugaccccccccauugagaggaccaucuaucggaugguugacuugcccguguugcagccgcggcugugcacgcaugcucguuggccagcgccgauuuauggucucuuggugggccccucccucccggcuaacccccaauggcagaauggaagagugcauguugauggaacccuucuugguacaacaccuguuucugggucuugggucuccugcuuugcugcugaggccgccuacgaguuccaaucugggacuggugagguggcggccuucacccugauugagcaggauggauccgcuuauguccccggcgacagagcggccccccugggcuaccccgacuucucuggacagcuggagauugaggugcagacugagaccaccaagacaggcgacaaguuaacggugaccacuuuugagaugauucuuggucccaccaccaacguggaccaggcgccuuuccaggguaggguauacgcuagcuuaacggcugcggccucccucgaccugguggauggcagaguuagagcggucccgcgcuccaucuaugguuuccaggaugugauucccgaguauaaugauggucuucuuguuccccuugcccccccuauuggccccuuucuucccggcgagguucuucugagguuccggaccuauaugcgccagauugacagcucugacgcugcagcggaagccauugacugcgcucucccacaagaguuuaucucgugguuugcgaguaacgcauucacggugcagucggaggcucugcuccuuagguauaggaacacccugacugagcaauugcuguuugaguguaagcucuacagcgaaggcuauauugcccuguccuauucgggcucaggaccacucaccuucccgacugauggcuucuuugaagccgucagcuggguuccccgucuuuaucaauuggccucugugggaagcuuggcaacgggccggacacucaaacaauaa

SEQ ID NO: 5977 - RNA, 1626 nt, Artificial Sequence
  capsid_protein__Norovirus__ABG45851
augaggaugagugauggcgcagcgccaaaagccaacggcucugaagccagcggccaggaucuuguuccuaccgccguugaacaggccguccccauucagcccguggcuggugcgucucuugccgcccccgccgccgggcaaauuaaccaaauugaccccuggaucuuccaaaauuuuguccaaugcccccuuggugaguuuuccauuucaccucgaaacaccccaggugaaauacucuuugauuuggcccucgggccagggcucaacccuuaccuugcccaccucucagccauguacaccggcuggguugggaacauggagguucagcugguccucgccggcaaugccuuuacugcuggcaagguggcuguugcccuuguaccacccuauuuucccaaagggucacucaccacugcucagaucacaugcuucccacaugucaugugugaugugcgcacccuggagcccauucaacucccucuucuugaugugcgucgaguucuuuggcaugcuacccaagaucaggaggaaucuaugcgccuggucugcaugcuguacacgccacuccgcacaaauagcccgggugaugagucuuuuguggucucuggccgccuucuuucuaagccagcagcugauuucaauuuuguguaccugaccccccccauugagaggaccaucuaucggaugguugacuugcccguguugcagccgcggcugugcacgcaugcucguuggccagcaccgauuuauggucucuugguggaccccucccucccggcuaacccccaauggcagaauggaagagugcauguugauggaacccuucuugguacaacaccuguuucugggucuagggucuccugcuuugcugcugaggccgccuacgaguuccaaucugggacuggugagguggcgaccuucacccugauugagcaggauggauccgcuuauguccccggcgacagagcggccccccugggcuaccccgacuucucuggacagcuggagauugaggugcagacugagaccaccaagacaggcgacaaguuaacggugaccacuuuugagaugauucuuggucccaccaccaacguggaccaggcgccuuuccaggguagggcauacgcuagcuuaacggcugcggccucccucgaccugguggauggcagaguuagagcggucccgcgcuccaucuauaguuuccaggaugugauucccgaguauaaugauggucuucuuguuccccuugcccccccuauuggccccuuucuucccggcgagguucuucugagguuccggaccuauaugcgccagauugacagcucugacgcugcagcggaagccauugacugcgcccucccacaagaguuuaucucgugguuugcgaguaacgcauucacggugcagucggaggcucugcuccuuagguauaggaacacccugacugggcaauugcuguuugaguguaagcucuacagcgaaggcuauauugcccuguccuauucgggcucaggaccacucaccuucccgacugauggcuucuuugaagucgucagcuggguuccccgucuuuaucaauuggccucugugggaagcuuggcaacgggccggacacucaaacaauaa

SEQ ID NO: 5978 - RNA, 1626 nt, Artificial Sequence
  capsid_protein__Norovirus__ABI95835
augaggaugagugauggcgcagcgccaaaagccaacggcucugaagccagcggccaggaucuuguuccuaccgccguugaacaggccguccccauucagcccguggcuggugcgucucuugccgcccccgccgccgggcaaauuaaccaaauugaccccuggaucuuccaaaauuuuguccaaugcccccuuggugaguuuuccauuucaccucgaaacaccccaggugaaauacucuuugauuuggcccucgggccagggcucaacccuuaccuugcccaccucucagccauguacaccggcuggguugggaacauggagguucagcugguccucgccggcaaugccuuuacugcuggcaaggugguuguugcccuuguaccacccuauuuucccaaagggucacucaccacugcucagaucacaugcuucccacaugucaugugugaugugcgcacccuggagcccauucaacucccucuucuugaugugcgucgaguucuuuggcaugcuacccaagaucaggaggaaucuaugcgccuggucugcaugcuguacacgccacuccgcacaaauagcccgggugaugagucuuuuguggucucuggccgccuucuuucuaagccagcagcugauuucaauuuuguguaccugaccccccccauugagaggaccaucuaucggaugguugacuugcccguguugcagccgcggcugugcacgcaugcucguuggccagcaccgauuuauggucucuugguggaccccucccucccggcuaacccccaauggcagaauggaagagugcauguugauggaacccuucuugguacaacaccuguuucugggucuugggucuccugcuuugcugcugaggccgccuacgaguuccaaucugggacuggugagguggcgaccuucacccugauugagcaggauggauccgcuuauguccccggcgacagagcggccccccugggcuaccccgacuucucuggacagcuggagauugaggugcagacugagaccaccaagacaggcgacaaguuaacggugaccacuuuugagaugauucuuggucccaccaccaacguggaccaggcgccuuuccaggguagggcauacgcuagcuuaacggcugcggccucccucgaccugguggauggcagaguuagagcggucccgcgcuccaucuauaguuuccaggaugugauucccgaguauaaugauggucuucuuguuccccuugcccccccuauuggccccuuucuucccggcgagguucuucugagguuccggaccuauaugcgccagauugacagcucugacgcugcagcggaagccauugacugcgcccucccacaagaguuuaucucgugguuugcgaguaacgcauucacggugcagucggaggcucugcuccuuagguauaggaacacccugacugggcaauugcuguuugaguguaagcucuacagcgaaggcuauauugcccuguccuauucgggcucaggaccacucaucuucccgacugauggcuucuuugaagucgucagcuggguuccccgucuuuaucaauuggccucugugggaagcuuggcaacgggccggacacucaaacaauaa

SEQ ID NO: 5979 - RNA, 1620 nt, Artificial Sequence
  capsid_protein__Norovirus__ABI97981
augaagauggcgucgaaugacgccaacccaucugauggguccacagccaaccucgucccagaggucaacaaugagguuauggcuuuggagcccguuguuggugccgcuauugcggcaccuguggcgggccaacaaaauguaauugaccccuggauuagaaauaauuuuguacaagccccugguggagaguuuacaguguccccuagaaacgcuccgggugagauacuauggagcgcgccuuugggcccugauuugaaccccuaccuuucucauuuggccagaacguacaaugguuaugcaggugguuuugaagugcagguaauccucgcggggaacgcguucaccgccgggaaaaucauauuugcagcagucccaccaaauuuuccaacugaaggcuugagccccagccagguuaccauguucccccauauaauaguagauguuaggcaauuggaacccguguugauccccuuaccugauguuaggaauaacuucuaucauuacaaucaaucaaaugauucuaccauuaaauugauagcaaugcuguauacaccacuuagggcuaauaaugcuggggaugacgucuucacagucucuugucgaguccucacgaggccaucccccgauuuugauuucauauucuuggugccacccacaguugaaucaagaacuaaaccauucaccgucccaaucuuaacuguugaggaaauguccaauucaagauuccccauuccuuuggaaaaguuguacacgggucccagcagugcuuuuguuguccaaccacaaaauggcaggugcacgacugauggcgugcucuuaggcacuacccagcugucugcugucaacaucugcaccuucagaggggaugucacccacauugcaggcagucaugacuauacaaugaauuuggcuucucaaaauuggaacaauuaugacccgacagaagaaaucccagccccucugggaacuccagauuucgugggaaagauccaaggcaugcucacccaaaccacaagagaggaugguucgacccgcgcccacaaagcuacagugagcacugggaguguccacuuuacuccaaagcugggcaguguucaauacaccacugacacaaacaaugauuuucaaacuggccaaaacacgaaauucaccccagucggcgucauccaggacgguaauaaccaucaaaaugaaccccaacaaugggugcucccaaauuacucagguagaacuggucauaaugugcaucuagcuccugccguugcccccacuuucccgggugagcaacuucuuuucuuuagguccacuaugcccggauguagcggguaucccaacaugaaccuggauugccuacucccccaggaaugggugcagcauuucuaccaagaagcagcuccagcacaaucugauguggcucugcugagauuugugaauccagacacaggcaggguucuguuugagugcaagcuccauaaaucaggcuaugucacaguggcucacacuggcccgcaugauuugguuauccccccaaaugguuacuucagauuugauuccugggucaaccaguucuacacacuugcccccaugggaaauggagcggggcgcagacgugcguuauaa

SEQ ID NO: 5980 - RNA, 1626 nt, Artificial Sequence
  capsid_protein__Norovirus__ABP99038
augaggaugagugauggcgcagcgccaaaagccaacggcucugaagccagcggccaggaucuuguuccuaccgccguugaacaggccguccccauucagcccguggcuggugcgucucuugccgcccccgccgccgggcaaaucaaccaaauugaccccuggaucuuccaaaauuuuguccaaugcccccuuggugaguuuuccauuucaccucgaaacaccccaggugaaauacuguuugauuuggcccucgggccagggcucaaucccuaccuugcccaccucucagccauguacaccggcuggguugggaacauggagguucagcugguccucgccggcaaugccuuuacugcuggcaaggugguuguugcccuuguaccacccuauuuucccaaagggucacucaccacugcucagaucacaugcuucccacaugucaugugugaugugcgcacccuggagccuauucaacucccucuucuugacgugcgucgaguucuuuggcaugcuacccaggaucaggaggaaucuaugcgccuggucugcaugcuguacacgccacuccgcacaaacagcccgggugaugagucuuuuguggucucuggccgccuucuuucuaagccggcagcugauuucaacuuuguauaccugaccccccccauugagaggaccaucuaucggaugguugacuugcccgccuugcagccgcggcugugcacgcacgcucguuggccagcaccgguuuauggucucuuaguggaucccucccucccgucuagcccccaguggcagaauggaagagugcauguugauggaacccuccuuggcacaacaccuguuucugggucuugggucuccugcuuugcugcugaggccgccuacgaguuccagucugggacuggugagguggcgaccuccacccugauugagcaggauggguccgccuacgucccuggcgagagggcggccccccucgguuaccccgacuuuucugggcaacuggagauugaagugcagaccgagaccacuaaggcgggugauaagcuaaggguaaccaccuuugagaugauccuugguccuaccaccaacguggaucaggcgcccuaccaggguagaguguacgccagcuuaacggcugcggccucucuugaccugguagauggcagaguuagggcgguuccgcgcucuaucuauggcuuccaggaugugauucccgaguauaaugauggccuucuuguuccccuugcccccccuauuggccccuuucuccccggcgagguucuccugagguuccggaccuauaugcgccagauugauagcucugacgccgcagcggaagccauugacugcgcccuuccacaagaguucaucucgugguucgcgagcaacgcguucacggugcagucggaggcucugcuccuuagguauaggaacacccugacugggcaauugcuguuugagugcaagcucuacagcgaagguuacauugcccuguccuacucgggcucaggaccacuugccuuuccgacugacggcuucuuugaagucgucagcuggguuccccgucuuuaucaauuggccucugugggaagcuuggcaacaggccgaacacucaaacaauaa

SEQ ID NO: 5981 - RNA, 1626 nt, Artificial Sequence
  capsid_protein__Norovirus__ABP99041
augaggaugagugauggcgcagcgccaaaagccaacggcucugaagccagcggccaggaucuuguuccuaccgccguugaacaggccguccccauucagcccguggcuggugcggcucuugccgcccccgccgccgggcaaaucaaccaaauugaccccuggauuuuccaaaauuuuguccaaugcccccuuggugaguuuuccauuucaccucgaaacaccccaggugaaauauuguuugaucuggcccucgggccagggcucaaccccuaccuugcccaccucucagccauguacaccggcuggguugggaacauggagguucagcugguccucgccggcaaugccuuuacugcuggcaaggugguuguugcccuuguaccacccuauuuucccaaagggucacucaccacugcucagaucacaugcuucccacaugucaugugugaugugcgcacccuggagcccauucaacucccucuucuugacgugcgucgaguucuuuggcaugcuacccaggaucaggaggaaucuaugcgccuggucugcauguuguacacgccacuccgcacaaauagcccgggugaugagucuuuuguggucucuggccgccuucuuucuaagccggcggcugauuucaauuuugucuacuuaaccccucccaucgagagaaccaucuaccggauggucgacuugcccguguugcagccgcggcugugcacgcacgcucguuggccggccccggucuauggccucuugguagacccaucccuuccauccaacccccaguggcagaaugguagagugcauguugaugggacccuucuugguacaacaccugugucugguucuuggguuuccugcuucgcagcugaagccgccuacgaguuccaaucugggacuggcgagguggcgaccuucaccaugauugagcaggauggguccgccuacgucccuggugacagggcggccccccuuggguaccccgacuucuccgggcaacuggagaucgaggugcagacugagaccaccaaggcgggugacaaacucaaggugaccaccuuugauaugauccugggccccaccaccaacguggaccaggcccccuaccagggcagggcguacgcgagcuugacggccgcggccucgcucgaccugguggaugggaggguuagggcagucccacgcuccaucuauuccuuccaagaugagcucccagaauauaaugauggucuuuugguuccccuugccccuccccuaggucccuuucuuccuggcgagguuuuguugagguuucguaccuacaugcgccagcuugacaccgcugacgccucagcgcagccgauugacugugccuugccccaggaguucaucuccugguuugcaagcaacaacuucacaguucagucggacgcgcuccugguuagguaccgaaauaccuuaaccggccagcuucuguuugaggcuaagcuuuauagugaaggcuacauugcugugucuuauucaggcucuggcccccucaccuuucccacugacggcuucuuugagguugucagcugggucccccgccucuuucaauuggccucugugggaagcuuggcaacaggccgaacacucaaacaguaa

SEQ ID NO: 5982 - RNA, 1623 nt, Artificial Sequence
  capsid_protein__Norovirus__ABQ12784
augaagauggcgucgaaugacgccaccccaucugauggguccgcagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugauucccuugccugauguuaggaacaauuucuaucauuacaaucaaucaaaugaccccaccaucaaacugauagcaaugcuguauacaccacuuagggcuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagauucccuauuccuuuggaaaaguuguucacgggucccagcaguuccuuuguuguucaaccacaaaauggcagaugcacgacugauggcgugcucuuagguacuacccaacugucucccgucaacaucuguaccuucagaggggaugucacccacauugcagguacucaaaauuacacaaugaaucuggccucccaaaauuggaacaauuaugacccaacagaagaaaucccagccccucugggaaccccagauuuuguaggaaagauccaaggcgugcucacccaaaccacaaggagggauggcucgacccgcggucauaaagccacagugagcacuggaaguguccacuuuacuccaaagcugggcaguguucaauucuccacugauacaagcaaugacuuugaaaccggccaaaacacgagguucaccccagucggugucguccaggaugguaguaccaccccccaaaaugaaccccaacagugggugcucccagacuauucagguagagauagucacaauguacaccuagccccugcuguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacuacugagauuugugaauccagacacagguaggguucuguuugagugcaagcuucauaaaucaggcuauguaacaguggcccacacuggccaacaugauuugguuaucccccccaauggcuauuuuagauuugauuccugggucaaccaauucuacacacuugcccccaugggaaauggagcggggcguagacgugcauuauaa

SEQ ID NO: 5983 - RNA, 1737 nt, Artificial Sequence
  capsid_protein__Norovirus__ABR15783
augaagauggcgucuagugacgccaccccaucgucugauggugcuggcaaccucgucccagagagucaacaagaggucuugccacuugcucccguggcgggcgcggccuuagccgcaccaguugugggacaacagaacauaauugaccccuggauuaaagaaaauuuugugcaggcuccccagggugaauucaccguuucacccaagaauuccccuggcgagguccuggucaacuuggagcugagcccuagguugaacccuuauuuacaccaccuuucaaagauguauaaugccuaugcuggcggcauggaggucgagauaauccucgcugggaacgcuuucacugccggcaaaguacucauugcagcggugccaccaaauuuccccaucgagaacgucucggccucucaggcuagccaguucccccaugugauuguggauguuagaacucuugagcccauucgccuaccccugccugacgugcgcaccaacuucuuccacuacaccacacaggaggagcccaggaugcgcaucgucgcuuggcucuacaccccguugaggacgaacggcagcggcgaugauucauuuacagucucugggcguauuuugacacgcccauccccagauuuugaguuuucuuucuugguuccgccaacugucgagacuaagaccgucucauucucaguuccuggcuuggucguccaggauauguccaacuccagguggccugcccagaucagcggguuggucgucaggggcaaugaggcccagguugugcacuuucaaaauggcaggugcaccaccgaaggcaugcuccuuggcacaaccacgcucaacauuaauuccaucuguggucugcggggacuuucagucucucaagccuccgugcgcggcgcccccgcgcucaccgaggagaugccgccucucgaggaugagguggcugauggugccgccgccaccuacacccucacccgcgccgcggacaccgcgcuguggcugaggguggaggaacccgauggccgccccuaugacaucuucggggaucagccggcaccccuagggacgcccgacuucacggcagugauugucggcaccgccaucaggccucgcaccacgucuggcgcguaccuccacgacgccuacguggacaccacccccggcgacgcugauuucaccccuuccacugggaacaccaagaucgugcugcgagguggugguucuggccacgucggucaaggccauuacuggcaguuuaagccgaucgcuguugagggugguggaaguagaccccaguaccaggaguacaaucugcccgauuacgccgggccgaccgcauccaaccaugaucuggcaccaccggucgcccccaggaugccuggugagcucuuguugcucuuugaaucugacaugccugugugggacaacggggccggcgcggcacccgcgcagaaaauucauugucuucuccccaaugaguucauaacccaccuguuugaucuccaagccccggcucucgccgaggcggcccuccugagguauguccacccugauagcgguagaacccucuuugaaugcaagcuuuacagagaaggcuacauggucguggccgcaccaguugguagacugaacuucccacucgauggguacuucagguuugauucuugggucagcgcauucuacguccucucccccgugggaagcggucaaggccgucggggcagguccaaggcugcauaa

SEQ ID NO: 5984 - RNA, 807 nt, Artificial Sequence
  capsid_protein__Norovirus__ABR24136
auggcuggggcuuucuuugcuggauuggcaucugauguccuuggcucuggacuugguucccugaucaaugcuggggcuggggccaucaaccaaaaaguugaauuugaaaauaacagaaaauugcaacaagcuuccuucgaauuuagcagcaaucuacaacaggcuuccuuucaacaugacaaagagaugcuccaagcacaaauugaggccacuaaaaaguuacagcaggguaugaugaaagucaaacaggcaaugcuccuagaggguggauucucugaaacagaugcggcccguggggcaaucaacgcccccaugacaaaggcuuuggacuggagcggaacaagguacugggcuccugaugcuagaacuacaacauacaaugcaggccguuuuucuaccccucaaccuucgggggcacugccaggaagaaccaaucccagggcuacuguccccgcucggggcucccccagcacaccuucuaacacuucuacuguuacuucugucuauucagaucaaacuguuucaacgagacuugguucuacagcugguucuggcaccagagucucgagucucccgucaacugcaaggacuaggagcuggguugaggaucaaaacaggaauuugucaccuuucaugaggggggcucacaacauaucguucgucaccccaccagcuaguagauccucuagccaaggcacagucucaaccgugcccaaagaaguuuuggacuccuggacuggcgcuuucaacacgcgcaggcagccucucuucgcucacauucguaagcgaggggagucacgggcguaa

SEQ ID NO: 5985 - RNA, 1647 nt, Artificial Sequence
  capsid_protein__Norovirus__ABS12173
augaagauggcgucgaaugacgccacuccaucuaaugauggugccgccggccucgucccagagaucaacaaugaggcaauggcgcuagauccaguggcgggugcagcgauagcagcaccccucacuggccagcaaaauauaauugaucccuggauuaugaauaauuuugugcaagcaccugguggugaguuuacaguguccccuaggaauuccccuggugaagugcuucucaauuuggaauugggcccagaaauaaaucccuauuuggcccaucuugcuagaauguauaaugguuaugcagguggguuugaagugcagguaguccuagcuggaaaugcguuuacagcaggaaagauaaucuuugcagcuauacccccuaauuucccaauugacaaucuaagcgcagcacagaucacaaugugcccacaugugauuguggaugucagacaguuggaaccggucaaccuuccgaugccugacguucgcaauaacuucuuccauuacaaccaagggucugauucgagauugcgcuuaauugcaaugcuguauacaccucuuagggcaaauaauucuggggaugauguuuuuacugugucuuguagagugcugacuaggccuagcccugacuuuucauuuaauuuccuugugccaccuacuguggagucaaagacaaaacccuucacccucccuauucugacuaucucugaaaugucuaauucuagguuuccagugccgauugauucucugcacaccagcccaacugagaauauuguuguccagugccaaaauggacgcgucacucuugauggugaguugaugggcaccacccaacucuuaccuagucaaaucugugcuuuuaggggcgugcucaccagaucaacaagcaggcccagugaucaggccgacacagcaaccccuagauuguuuaauuauuauuggcacauacaauuggauaaucuaaaugggacuccuuaugauccugcagaagacauaccaggcccccuggggacaccagauuuccggggcaaagucuuuggcguggccagccagagaaaucccgacaguacaacuagagcacaugaagcaaagguggacacaacagcuggucguuuuaccccaaaacuaggcucauuagagauauccacugaaucuggugacuuugaucaaaaccaaccaacaagauucaccccaguuggcauugggguugaccacgaggcagauuuccaacaauggucuuuacccgacuauucuggucaguucacccacaacaugaacuuagccccagcuguugcucccaacuucccuggugagcagcuccuuuucuuccgcucgcaguuaccaucuucuggugggcgauccaacgggauucuagacugccuggucccccaagaauggguccagcacuucuaccaagaaucggcccccgcccaaacccaaguggcccugguuagauaugucaacccugacacugguagaguguuguuugaggccaagcugcacaaauuagguuucaugacuauagcuaagaauggugacucuccaauaacuguccccccaaauggauacuuuagguuugaaucuugggugaacccauuuuauacacuugcccccaugggaacugggaaugggcguagaaggauucaauaa

SEQ ID NO: 5986 - RNA, 1611 nt, Artificial Sequence
  capsid_protein__Norovirus__ABS12175
augaagauggcgucgaaugacgcuacuccaucugaugauggugcagccggccucguaccagagaucaacagugagguuauggcucuugaacccgucgcuggggccucccuugcagcccccguagucggccaacagaauauaauugaucccuggauuagaaauaauuuuguacaagccccugcuggugaauucacaguuuccccuagaaacucuccuggagaacuucuacuugauuuggaauuggguccugaacuuaaucccuaucuugcacauuuggccaggauguacaaugggcaugcgggaggaauggaagugcagauaguacuggcugggaaugcguucacagcugguaaaauccuauuugcugccaucccgccuagcuuccccuaugaaaauuugucacccgcucaauugacuaugugcccccaugugauaguggaugugagacaauuagaaccagugcuucugccaaugccagauauaagaaauguuuucuaucacuauaaccagaacaauagucccaaacuuaggcuuguagcuaugcuuuauacuccucugagggcuaacaacucaggugaugacguguucacgguaucuugccgcguuuuaacacguccuucuccagauuuccaguucaccuuucuggucccaccuacaguugagucuaaaacuaagaauuucacccuucccguucuuagagucucagagaugacaaauucaagguuccccguuguuuuggaccaaauguauacaagcaggaaugaaaacaucauuguccaaccccaaaacggcaggugcacgacugacggugagcugcuuggcacuaccaucuugcagucugugucuauuugcaauuuuaaaggaacaaugcaggcaaagcugaaugaagaaccacgauaccaguuacaacucaccaacuuggaugggucacccauagauccaacagaugauaugccugccccucuuggcacaccagauuuccaggccauguuauauggcguugcaagccaacgcucuuccagagacaaugccaccagggcacaugaugcacagauugacacugcgggcgacacauucgccccgaaaauuggccagguucguuuuaaaucaagcucuaaugauuuugaccuacaugacccuacaaaauucacaccuauuggugucaauguggaugaucagcacccuuuuagacagugguuccuaccaaacuacgguggucaccuugcccugaacaaucauuuagcccccgcugugacaccacucuuuccuggcgagcagauuuuauucuucaggucauacauuccaagcgccggaggccacacagacggugcuauggacugcuugcugccccaagaguggguagagcacuucuaccaggaagcugccccuucccaaucugacaucgcacugguaagguucaucaacccugacacaggaagagugcucuuugaagcuaaauugcauaaacaagguuuccucacaauugcagcaucuggagaucacccuauugugaugcccacuaaugguuacuuuagguuugaagcuuggguuaacccuuucuauacucucgcccccgugggaacugggucugggcgcaggaggauucaauaa

SEQ ID NO: 5987 - RNA, 1626 nt, Artificial Sequence
  capsid_protein__Norovirus__ABS29273
augaggaugagugauggcgcagcgccaaaagccaacggcucugaggccagcggccaggaucuuguuccuaccgccguugaacaggccguccccauucagcccguggcuggcgcggcucuugccgcccccgccgccgggcaaauuaaccaaauugaccccuggaucuuccaaaauuuuguccagugcccccuuggugaguuuuccauuucaccucgaaacaccccaggugaaauacuguuugauuuggcccucgggccagggcucaaccccuaccuugcccaucucucagccauguacaccggcuggguugggaacauggagguucagcugguccucgccggcaaugccuuuacugcuggcaaggugguuguugcccuuguaccacccuacuuucccaagggaucacucaccaccgcccagaucacaugcuucccacaugucaugugugaugugcgcacccuggaaccuauucagcucccucuccuugaugugcgucggguccuuuggcaugcuacccaggaucaagaggaaucuaugcgcuugguuugcaugcuguacacgccacuccgcacaaacagcccgggugaugagucuuuuguggucucuggccgccuucuuucuaagccagcggcugauuuuaacuuugucuaccugaccccccccauagagagaaccauuuaccggauggucgacuugcccgugauacagccgcggcugugcacgcacgcacguuggccugccccgauuuauggccucuuaguggacccaucccuccccucaaacccccaguggcagaauggaagggugcacguugauggaacccugcuuggcaccaccccaaucuccgguucguggguguccugcuuugcagcggaggcugccuaugaguuccaaucaggcaucggugagguggcgacguucacccugauugagcaggauggaucugccuacguccccggugacagggcagcaccacucgguuaccccgauuucucugggcaacuggagaucgagguccagaccgagaccaccaagacuggagacaagcucaaggucaccacuuuugagaugauucuuggcccaacgaccaacgcggaccaggcccccuaccagggcaggguguucgccagcgucacugcugcggccucucuugacuugguggauggcaggguucgugcggucccaagauccgucuacagcuucugugauaccaucccugaauacaacgaugggcuacuggucccccuugcucccccaauuggucccuuccuccccggcgagguccuccugagguuccggaccuacaugcgucagcuugacaccgcugacgccgcagcagaggcgauagacugcgcacucccccaggaguuugucuccugguucgcguccaacgcguucacagugcaguccgaggcccugcuccuuagguacaggaacacccugacugggcaacugcuguucgagugcaagcucuacagcgaagguuacauugccuuguccuauuccggcucagggccccucaccuucccaaccgauggcuucuuugaggucgucagcugggucccccgccuuuaucaauuggccucugugggaagcuuggcaacaggccgaacacucaaacaauaa

SEQ ID NO: 5988 - RNA, 1626 nt, Artificial Sequence
  capsid_protein__Norovirus__ABS29275
augaggaugagugauggcgcagcgccaaaagccaauggcucugaagccagcggccaggaucuuguuccuaccgccguugaacaggccguccccauucagcccguggcuggcgcggcucuugccgcccccgccgccgggcaaaucaaccagauugaccccuggaucuuccaaaauuuuguccagugcccccuuggugaguuuuccauuucaccucgaaacaccccaggugaaauacuguuugauuuggcccucgggccagggcucaaccccuaccuugcccaucucucagccauguacaccggcuggguugggaacauggagguucagcugguccucgccggcaaugccuuuacugcuggcaaggugguuguugcccuuguaccacccuacuuucccaagggaucacucaccaccgcccagaucacaugcuucccacaugucaugugugaugugcguacccuggagcccauucaacucccucuucuugaugugcgucgaguccuuuggcaugcuacccaggaucaagaggaaucuaugcgccugguuuguaugcuguacacgccacuccgcacaaacagcccgggugaugagucuuuuguggucucuggccgccuucuuucuaagccggcggcugauuucaauuuugucuaccugacuccccccauagagagaaccauuuaccggauggucgacuugcccgugauacagccgcggcugugcacgcacgcacguuggccugccccggucuauggccucuugguggacccaucccuccccucaaacccccaguggcagaauggaagggugcauguugauggaacccugcuuggcaccaccccaaucuccgguucauggguguccugcuuugcagcggaggcugccuaugaguuccaaucgggcaucggugagguggcgacguucacccugaucgagcaggauggauccgccuacauccccggugacagggcagcaccacucggcuaccccgauuucuccgggcaacuggagaucgagguccagaccgagaccaccaagacuggagacaagcucaaggucaccaccuuugagaugguccuuggcccaacgaccaacguggaccaggcccccuaccagggcaggguguacgccagcgucaccgcugcggccucucuugacuugguggacggcaggguucgugcggucccaagauccaucuacagcuuucaagacaccaucccugaguauaacgaugggcuauugguuccccuugcccccccaauuggucccuuucuccccggcgagguccuccugagguuccggaccuauaugcgucagcucgacaccgcugacgccgcagcagaggcgauagacugcgcacucccccaggaguucgucuccugguucgcguccaacgcguucacagugcaguccgaggcucugcuccucagguacaggaacacccugacugggcaauugcuguuugagugcaagcucuacagugaagguuauauugccuuguccuauuccggcucagggccccucaccuucccgaccgauggcuucuuugaggucgucagcugggucccccgccuuuaucaauuggccucugugggaagcuuggcaacaggccgaacacucaagcaauaa

SEQ ID NO: 5989 - RNA, 1626 nt, Artificial Sequence
  capsid_protein__Norovirus__ABU55541
augaggaugagugauggcgcagcgccaaaagccaauggcucugaggccagcggccaggaucuuguuccugccgccguugaacaggccguccccauucaacccguggcuggcgcggcucuugccgcccccgccgccgggcaaauuaaccaaauugaccccuggaucuuccaaaauuuuguccagugcccccuuggugaguuuuccauuucgccucgaaacaccccaggugaaauacuguuugauuuggcccucgggccagggcuuaaccccuaccuugcccaccucucagccauguacaccggcuggguugggaacauggagguucagcugguccucgccggcaaugccuuuacugcuggcaaggugguuguugcccuuguaccacccuauuuucccaaggggucacucaccacugcccagaucacaugcuucccacaugucaugugugaugugcgcacccuggagcccauucaacucccucuucuugaugugcgucgaguccuuuggcaugcuacccaggaucaagaggaaucuaugcgccugguuugcaugcuguacacgccacuccgcacaaacagcccgggugaugagucuuuugugguuucuggccgccuucuuucuaagccggcggcugauuucaauuuugucuaccuaacuccccccauagagagaaccaucuaccggauggucgacuugcccgugauacagccgcggcugugcacgcacgcacguuggccugccccggucuauggucucuugguggacccaucccuccccucaaauccccaguggcagaauggaagggugcacguugaugggacccugcuugguaccaccccaaucuccgguucauggguguccugcuuugcggcggaggcugccuauaaguuccaaucgggcaccggugagguggcgacauucacccugauugagcaggauggaucugccuacguccccggugacagggcagcaccacucgguuaccccgauuucucugggcaacuggagaucgagguccagaccgagaccaccaagacuggagacaagcucaaggucaccacuuuugagaugauucuuggcccaacgaccaacgcggaccaggcccccuaccagggcaggguguucgccagcgucacugcugcggccucucuugacuugguggauggcaggguucgugcggucccaagauccaucuacgguuuucaggacaccaucccugaauacaacgaugggcuacugguuccccuugcccccccaauuggucccuuucuccccggcgagguccuccugagguuccggaccuacaugcgucagaucgacaccgcugacgccgcagcagaggcgauagacugugcacucccccaggaguuugucuccugguucgcgucuaacgcguucaccgugcaguccgaggcccugcuccuuagauacaggaacacccugacugggcaacugcuguucgagugcaagcucuacaacgaagguuacaucgccuugucuuauuccggcucaggaccccucaccuucccgaccgauggcaucuuugaggucgucaguuggguuccucgccuuuaccaauuggccucugugggaaguuuggcaacaggccgaaugcucaaacaauaa

SEQ ID NO: 5990 - RNA, 1626 nt, Artificial Sequence
  capsid_protein__Norovirus__ABU55544
augaggaugagugauggcgcagcgccaaaagccaauggcucugaggccagcggccaggaucuuguuccugccgccguugaacaggccguccccauucaacccguggcuggcgcggcucuugccgcccccgccgccgggcaaauuaaccaaauugaccccuggaucuuccaaaauuuuguccagugcccccuuggugaguuuuccauuucgccucgaaacaccccaggugaaauacuguuugauuuggcccucgggccagggcuuaaccccuaccuugcccaccucucagccauguacaccggcuggguugggaacauggagguucagcugguccucgccggcaaugccuuuacugcuggcaaggugguuguugcccuuguaccacccuauuuucccaaggggucacucaccacugcccagaucacaugcuucccacaugucaugugugaugugcgcacccuggagcccauucaacucccucuucuugaugugcgucgaguccuuuggcaugcuacccaggaucaagaggaaucuaugcgccugguuugcaugcuguacacgccacuccgcacaaacagcccgggugaugagucuuuugugguuucuggccgccuucuuucuaagccggcggcugauuuuaauuuugucuaccuaacuccccccauagagagaaccaucuaccggauggucgacuugcccgugauacagccgcggcugugcacgcacgcacguuggccugccccggucuauggucucuugguggacccaucccuccccucaaauccccaguggcagaauggaagggugcacguugaugggacccugcuugguaccaccccaaucuccgguucauggguguccugcuuugcggcggaggcugccuauaaguuccaaucgggcaccggugagguggcgacauucacccugauugagcaggauggaucugccuacguccccggugacagggcagcaccacucgguuaccccgauuucucugggcaacuggagaucgagguccagaccgagaccaccaagacuggagacaagcucaaggucaccacuuuugagaugauucuuggcccaacgaccaacgcggaccaggcccccuaccagggcaggguguucgccagcgucacugcugcggccucucuugacuugguggauggcaggguucgugcggucccaagauccaucuacgguuuucaggacaccaucccugaauacaacgaugggcuacugguuccccuugcccccccaauuggucccuuucuccccggcgagguccuccugagguuccggaccuacaugcgucagaucgacaccgcugacgccgcagcagaggcgauagacugugcacucccccaggaguuugucuccugguucgcgucuaacgcguucaccgugcaguccgaggcccugcuccuuagauacaggaacacccugacugggcaacugcuguucgagugcaagcucuacaacgaagguuacaucgccuugucuuauuccggcucaggaccccucaccuucccgaccgauggcaucuuugaggucgucaguuggguuccucgccuuuaccaauuggccucugugggaaguuuggcaacaggccgaaugcucaaacaauaa

SEQ ID NO: 5991 - RNA, 1626 nt, Artificial Sequence
  capsid_protein__Norovirus__ABU55547
augaggaugagugauggcgcagcgccaaaagccaauggcucugaggccagcggccaggaucuuguuccugccgccguugaacaggccguccccauucaacccguggcuggcgcggcucuugccgcccccgccgccgggcaaauuaaccaaauugaccccuggaucuuccaaaauuuuguccagugcccccuuggugaguuuuccauuucgccucgaaacaccccaggugaaauacuguuugauuuggcccucgggccagggcuuaaccccuaccuugcccaccucucagccauguacaccggcuggguugggaacauggagguucagcugguccucgccggcaaugccuuuacugcuggcaaggugguuguugcccuuguaccacccuauuuucccaaggggucacucaccacugcccagaucacaugcuucccacaugucaugugugaugugcgcacccuggagcccauucaacucccucuucuugaugugcgucgaguccuuuggcaugcuacccaggaucaagaggaaucuaugcgccugguuugcaugcuguacacgccacuccgcacaaacagcccgggugaugagucuuuuguggucucuggccgccuucuuucuaagccggcggcugauuucaauuuugucuaccuaacuccccccauagagagaaccaucuaccggauggucgacuugcccgugauacagccgcggcugugcacgcacgcacguuggccugccccggucuauggucucuugguggacccaucccuccccucaaauccccaguggcagaauggaagggugcacguugaugggacccugcuugguaccaccccaaucuccgguucauggguguccugcuuugcggcggaggcugccuauaaguuccaaucgggcaccggugagguggcgacauucacccugauugagcaggauggaucugccuacguccccggugacagggcagcaccacucgguuaccccgauuucucugggcaacuggagaucgagguccagaccgagaccaccaagacuggagacaagcucaaggucaccacuuuugagaugauucuuggcccaacgaccaacgcggaccaggcccccuaccagggcaggguguucgccagcgucacugcugcggccucucuugacuugguggauagcaggguucgugcggucccaagauccaucuacgguuuucaggacaccaucccugaauacaacgaugggcuacugguuccccuugcccccccaauuggucccuuucuccccggcgagguccuccugagguuccggaccuacaugcgucagaucgacaccgcugacgccgcagcagaggcgauagacugugcacucccccaggaguuugucuccugguucgcgucuaacgcguucaccgugcaguccgaggcccugcuccuuagauacaggaacacccugacugggcaacugcuguucgagugcaagcucuacaacgaagguuacaucgccuugucuuauuccggcucaggaccccucaccuucccgaccgauggcaucuuugaggucgucaguuggguuccucgccuuuaccaauuggccucugugggaaguuuggcaacaggccgaaugcucaaacaauaa

SEQ ID NO: 5992 - RNA, 1626 nt, Artificial Sequence
  capsid_protein__Norovirus__ABU55550
augaggaugagugauggcgcagcgccaaaagccaauggcucugaggccagcggccaggaucuuguuccugccgccguugaacaggccguccccauucaacccguggcuggcgcggcucuugccgcccccgccgccgggcaaauuaaccaaauugaccccuggaucuuccaaaauuuuguccagugcccccuuggugaguuuuccauuucgccucgaaacaccccaggugaaauacuguuugauuuggcccucgggccagggcuuaaccccuaccuugcccaccucucagccauguacaccggcuggguugggaacauggagguucagcugguccucgccggcaaugccuuuacugcuggcaaggugguuguugcccuuguaccacccuauuuucccaaggggucacucaccacugcccagaucacaugcuucccacaugucaugugugaugugcgcacccuggagcccauucaacucccucuucuugaugugcgucgaguccuuuggcaugcuacccaggaucaagaggaaucuaugcgccugguuugcaugcuguacacgccacuccgcacaaacagcccgggugaugagucuuuuguggucucuggccgccuucuuucuaagccggcggcugauuucaauuuugucuaccuaacuccccccauagagagaaccaucuaccggauggucgacuugcccgugauacagccgcggcugugcacgcacgcacguuggccugccccggucuauggucucuugguggacccaucccuccccucaaauccccaguggcagaauggaagggugcacguugaugggacccugcuugguaccaccccaaucuccgguucauggguguccugcuuugcggcggaggcugccuauaaguuccaaucgggcaccggugagguggcgacauucacccugauugagcaggauggaucugccuacguccccggugacagggcagcaccacucgguuaccccgauuucucugggcaacuggagaucgagguccagaccgagaccaccaagacuggagacaagcucaaggucaccacuuuugagaugauucuuggcccaacgaccaacgcggaccaggcccccuaccagggcaggguguucgccagcgucacugcugcggccucucuugacuugguggauggcaggguucgugcggucccaagauccaucuacgguuuucaggacaccaucccugaauacaacgaugggcuacugguuccccuugcccccccaauuggucccuuucuccccggcgagguccuccugagguuccggaccuacaugcgucagaucgacaccgcugacgccgcagcagaggcgauagacugugcacucccccaggaguuugucuccugguucgcgucuaacgcguucaccgugcaguccgaggcccugcuccuuagauacaggaacacccugacugggcaacugcuguucgagugcaagcucuacaacgaagguuacaucgccuugucuuauuccggcucaggaccccucaccuucccgaccgauggcaucuuugaggucgucaguuggguuccucgccuuuaccaauuggccucugugggaaguuuggcaacaggccgaaugcucaaacaauaa

SEQ ID NO: 5993 - RNA, 1626 nt, Artificial Sequence; identical to SEQ ID NO: 5992
  capsid_protein__Norovirus__ABU55553

SEQ ID NO: 5994 - RNA, 1626 nt, Artificial Sequence
  capsid_protein__Norovirus__ABU55556
augaggaugagugauggcgcagcgccaaaagccaauggcucugaugccagcggccaggaucuuguuccugccgccguugaacaggccguccccauucaacccguggcuggcgcggcucuugccgcccccgccgccgggcaaauuaaccaaauugaccccuggaucuuccaaaauuuuguccagugcccccuuggugaguuuuccauuucgccucgaaacaccccaggugaaauacuguuugauuuggcccucgggccagggcuuaaccccuaccuugcccaccucucagccauguacaccggcuggguugggaacauggagguucagcugguccucgccggcaaugccuuuacugcuggcaaggugguuguugcccuuguaccacccuauuuucccaaggggucacucaccacugcccagaucacaugcuucccacaugucaugugugaugugcgcacccuggagcccauucaacucccucuucuugaugugcgucgaguccuuuggcaugcuacccaggaucaagaggaaucuaugcgccugguuugcaugcuguacacgccacuccgcacaaacagcccgggugaugagucuuuuguggucucuggccgccuucuuucuaagccggcggcugauuucaauuuugucuaccuaacuccccccauagagagaaccaucuaccggauggucgacuugcccgugauacagccgcggcugugcacgcacgcacguuggccugccccggucuauggucucuugguggacccaucccuccccucaaauccccaguggcagaauggaagggugcacguugaugggacccugcuugguaccaccccaaucuccgguucauggguguccugcuuugcggcggaggcugccuauaaguuccaaucgggcaccggugagguggcgacauucacccugauugagcaggauggaucugccuacguccccggugacagggcagcaccacucgguuaccccgauuucucugggcaacuggagaucgagguccagaccgagaccaccaagacuggagacaagcucaaggucaccacuuuugagaugauucuuggcccaacgaccaacgcggaccaggcccccuaccagggcaggguguucgccagcgucacugcugcggccucucuugacuugguggauggcaggguucgugcggucccaagauccaucuacgguuuucaggacaccaucccugaauacaacgaugggcuacugguuccccuugcccccccaauuggucccuuucuccccggcgagguccuccugagguuccggaccuacaugcgucagaucgacaccgcugacgccgcagcagaggcgauagacugugcacucccccaggaguuugucuccugguucgcgucuaacgcguucaccgugcaguccgaggcccugcuccuuagauacaggaacacccugacugggcaacugcuguucgagugcaagcucuacaacgaagguuacaucgccuugucuuauuccggcucaggaccccucaccuucccgaccgauggcaucuuugaggucgucaguuggguuccucgccuuuaccaauuggccucugugggaaguuuggcaacaggccgaaugcucaaacaauaa

SEQ ID NO: 5995 - RNA, 1626 nt, Artificial Sequence
  capsid_protein__Norovirus__ABU55559
augaggaugagugauggcgcagcgccaaaagccaauggcucugaggccagcggccaggaucuuguuccugccgccguugaacaggccguccccauucaacccguggcuggcgcggcucuugccgcccccgccgccgggcaaauuaaccaaauugaccccuggaucuuccaaaauuuuguccagugcccccuuggugaguuuuccauuucgccucgaaacaccccaggugaaauacuguuugauuuggcccucgggccagggcuuaaccccuaccuugcccaccucucagccauguacaccggcuggguugggaacauggagguucagcugguccucgccggcaaugccuuuacugcuggcaaggugguuguugcccuuguaccacccuauuuucccaaggggucacucaccacugcccagaucacaugcuucccacaugucaugugugaugugcgcacccuggagcccauucaacucccucuucuugaugugcgucgaguccuuuggcaugcuacccaggaucaagaggaaucuaugcgccugguuugcaugcuguacacgccacuccgcacaaacagcccgggugaugagucuuuuguggucucuggccgccuucuuucuaagccggcggcugauuucaauuuugucuaccuaacuccccccauagagagaaccaucuaccggauggucgacuugcccgugauacagccgcggcugugcacgcacgcacguuggccugccccggucuauggucucuugguggacccaucccuccccucaaauccccaguggcagaauggaagggugcacguugaugggacccugcuugguaccaccccaaucuccgguucauggguguccugcuuugcggcggaggcugccuaugaguuccaaucgggcaccggugagguggcgacauucacccugauugagcaggauggaucugccuacguccccggugacagggcagcaccacucgguuaccccgauuucucugggcaacuggagaucgagguccagaccgagaccaccaagacuggagacaagcucaaggucaccacuuuugagaugauucuuggcccaacgaccaacgcggaccaggcccccuaccagggcaggguguucgccagcgucacugcugcggccucucuugacuugguggauggcaggguucgugcggucccaagauccaucuacgguuuucaggacaccaucccugaauacaacgaugggcuacugguuccccuugcccccccaauuggucccuuucuccccggcgagguccuccugagguuccggaccuacaugcgucagaucgacaccgcugacgccgcagcagaggcgauagacugugcacucccccaggaguuugucuccugguucgcgucuaacgcguucaccgugcaguccgaggcccugcuccuuagauacaggaacacccugacugggcaacugcuguucgagugcaagcucuacaacgaagguuacaucgccuugucuuauuccggcucaggaccccucaccuucccgaccgauggcaucuuugaggucgucaguuggguuccucgccuuuaccaauuggccucugugggaaguuuggcaacaggccgaaugcucaaacaauaa

SEQ ID NO: 5996 - RNA, 1626 nt, Artificial Sequence; identical to SEQ ID NO: 5992
  capsid_protein__Norovirus__ABU55562

SEQ ID NO: 5997 - RNA, 1626 nt, Artificial Sequence; identical to SEQ ID NO: 5992
  capsid_protein__Norovirus__ABU55565

SEQ ID NO: 5998 - RNA, 1626 nt, Artificial Sequence
  capsid_protein__Norovirus__ABU55568
augaggaugagugauggcgcagcgccaaaagccaacgguucugaagccagcggccaggauuuuguuccugccgccguugaacaggccguccccauucagcccguggcuggcgcggcucuugccgcccccgccgccgggcaaaucaaccaaauugaccccuggaucuuccaaaauuuuguccaaugcccccuuggugaguuuuccauuucaccucgaaacaccccaggugagauacuguuugaucuggcccucgggccagggcuuaaccccuaccuugcccaccucucagccauguacaccggcuggguugggaacauggagguucagcugguccucgccggcaaugccuuuacugcuggcaaggugguuguugcccuuguaccacccuauuuucccaaagggucacucaccacugcucagaucacaugcuucccacaugucaugugugaugugcgcacccuggagcccauucaacucccucuucuugacgugcgucgaguucuuuggcaugcuacccaggaucaggaggaaucuaugcgccugguuugcaugcuguacacgccacuccgcacaaacagcccgggugaugagucuuuuguggucucuggucgccuucuuucuaagccggcagcugauuucaacuuuguauaccugaccccccccauugagaggaccgucuaccggauggucgaccugcccgugcuacagccgcggcugugcacgcaugcucguuggccugccccggucuauggccucuugauagacccaucccuuccauccaacccccaguggcagaauggcagagugcauguuaaugggacccuucuuggcacaacaccugugucuggcuccuggguuuccugcuuugcagcugaggccgccuacgaguuccaguccgggauuggcgaaguggcgaccuucaccaugauugagcaggaugggucugccuauguccccggugauagggcggcuccccucggguaucccgacuucuccgggcaacuggagaucgaggugcagacugagaccaccaagucaggagauaaacuuaaggugaccacuuuugagaugauccucgguccuaccaccaacgcggaccaaacccccuaccagggcaaaguauacgcaagcauagcggcugcugccucgcucgaccugguggacgggaggguuagggcgguuccacgcuccgucuaugccuuucaggaugugcucccagaguacaaugauggccuuuuaguuccccucgcuccgccccugggccccuuucuccccggugaggucuuguugagguuccggaccuaugugcgucagcuggacaccgcugacgccgcagcgcagccgaucgacugugccuugccccaggaguuuaucuccugguuugcaagcaacaacuucacgguucagucggaugcgcuccuaaucagauaccggaacaccuugacuggccagcuccuguuugaggcuaagcucuauagcgaaggcuacauugcuguguccuacucgggaucugguccccucaccuucccuacugauggcuucuuugaggucgucagcugggucccccgccuuuuucaauuggccucugugggaagcuuggcaacaggccgaacacucaaacaguaa

SEQ ID NO: 5999 - RNA, 1626 nt, Artificial Sequence
  capsid_protein__Norovirus__ABU55571
augaggaugagugauggcgcagcgccaaaagccaacggcucugaggccagcggccaggaucuuguuccuaccgccguugagcaggccguccccauucagcccguggcuggcgcggcucuugccgcccccgccgccgggcaaaucaaccaaauugaccccuggaucuuccaaaauuuuguccaaugcccccuuggugaguuuuccauuucaccucgaaacaccccaggugagauacuguuugaucuggcccucgggccagggcuuaaccccuaccuugcccaccucucagccauguacaccggcuggguugggaacauggagguucaacugguccucgccggcaaugccuuuacugcuggcaaggugguuguugcccuuguaccacccuauuuucccaaagggucacucaccacugcucagaucacaugcuucccacaugucaugugugaugugcgcacccuggagcccauucaacuuccccuucuugaugugcgucgaguucuuuggcaugcuacccaggaccaggaggaaucuaugcgccugguuugcaugcuguacacgccacuccgcacaaacagcccgggugaugagucuuuuguggucucuggccgccuucuuucuaagccggcagcugauuucaauuuuguauacuugaccccccccauugagaggaccgucuaccggauggucgacuugcccguguuacagccgcggcugugcacgcacgcucguuggccugccccgaucuauggccucuugauagauccaucccucccauccaacccccaguggcagaauggcagagugcacguuaacgggacucuucuuggcacaacacccguguccgguuccuggguuuccugcuuugcagcugaggccgccuacgaguuccaguccgggacuggcgagguggcgacuuucaccaugauugagcaggauggauccgccuaugucccuggugauagggcggcuccccucggguaucccgacuucuccgggcaacuggagaucgaggugcagacugagacuaccaagacaggagauaaacucaaggugaccacuuuugagaugguccucggcccuaccaccaacguggaccaagcccccuaccaggguagaacauacgcaagccuaacggcugcggccucgcucgaccugguagaugggaggguuagggcgguuccacgcucuaucuauuccuuucaggaugugcuuccagaguauaaugauggucuuuuaguuccccuugcuccgccccuagggcccuuucuccccggugaggucuugcugagguuccggaccuacaugcgccagcuagacaccgcugacgccgcagcgcagccgaucgacugugccuugccccaggaguucaucuccugguuugcaagcaacaacuucacgguucagucggaugcgcuccugaucagauaccggaacaccuugacuggccagcuccuguuugaggcuaagcucuauagcgaaggcuacauugcuguguccuacucgggaucugguccccucacuuuccccacugauggcuucuuugaggucgucagcuggguuccccgccuuuuucaauuggccucugugggaagcuuggcaacaggccgaacacucaaacaguaa

SEQ ID NO: 6000 - RNA, 1626 nt, Artificial Sequence
  capsid_protein__Norovirus__ABU55577
augaggaugagugauggcgcagcgccaaaagccaacggcucugaagccaucggccaggaucuuguuccuaccgccguugaacaggccguccccauucagcccguggcuggcgcggcucuugccgcccccgccgccgggcaaaucaaccaaauugaccccuggaucuuccaaaauuuuguccaaugcccccuuggugaguuuuccauuucaccucgaaacaccccaggugagauacuguuugauuuggcccucgggccagggcuuaaccccuaccuugcccaccucucagccauguacaccggcuggguugggaacauggagguucagcugguccucgccggcaaugccuuuacugcuggcaaggugguuguugcccuuguaccacccuauuuucccaaagggucacucaccacugcucagaucacaugcuucccacaugucaugugugaugugcgcgcccuggagcccauucaacucccucuucuugaugugcgucgaguucuuuggcaugccacccaggaucaggaggaaucuaugcgccugguuugcaugcuguacacgccacuccgcacaaacagcccgggugaugagucuuuuguggucucuggccgccuucuuucuaagccggcagcugauuucaacuuuguauaccuaaccccucccauugagaggaccguuuaccggauggucgaccugcccgugcuacagccgcggcuguguacgcaugcucguuggccugccccggucuauggccucuugguagauccuucccucccauccaacccucaguggcagaauggcagagugcaugucaacgggacucuucuuggcacgacaccugugucuggcuccuggguuuccugcuuugcagcugaggccgccuacgaguuccaguccgggacuggcgagguggcgaccuucaccaugauugagcaggaugggucugccuauguccccggugauagggcggcuccccuuggguaucccgacuucuccgggcaacuggagaucgaggugcagacugagaccaccaagucaggagauaaacucaaggugaccacuuuugagaugauccucgguccaaccaccaacgcggaccaaacccccuaccagggcagaguauacgcaagcauagcggcugcggccccgcucgaccugguggacgggaggguuagggcgguuccacgcucugucuauuucuuucaggaugugcucccagaguacaaugauggucuuuuaguuccccuugccccgccccuaggccccuuccuccccggugaggucuuguugagguuccggaccuacgugcgucagcuggacaccgcugacgccgcagcgcagccgaucgacugugccuugccccaggaguuuaucuccugguuugcaagcaacagcuucacgguucagucggaagcgcuccugaucagauaccggaacaccuugaccggccagcuccuguuugaggcuaagcucuauagcgaaggcuacauugcuguguccuacucgggaucugguccccucaccuucccuacugauggcuucuuugaggucgucagcugggucccccgccuuuuccaauuggccucugugggaagcuuggcaacaggccgaacacucaaacaauaa

SEQ ID NO: 6001 - RNA, 1626 nt, Artificial Sequence
  capsid_protein__Norovirus__ABU55580
augaggaugagugauggcgcagcgccaaaagccaacggcucugaagccaucggccaggaucuuguuccuaccgccguugaacaggccguccccauucagcccguggcuggcgcggcucuugccgcccccgccgccgggcaaaucaaccaaauugaccccuggaucuuccaaaauuuuguccaaugcccccuuggugaguuuuccauuucaccucgaaacaccccaggugagauacuguuugauuuggcccucgggccagggcuuaaccccuaccuugcccaccucucagccauguacaccggcuggguugggaacauggagguucagcugguccucgccggcaaugccuuuacugcuggcaaggugguuguugcccuuguaccacccuauuuucccaaagggucacucaccacugcucagaucacaugcuucccacaugucaugugugaugugcgcgcccuggagcccauucaacucccucuucuugaugugcgucgaguucuuuggcaugcuacccaggaucaagaggaaucuaugcgccugguuugcaugcuguacacgccacuccgcacaaacagcccgggugaugagucuuuuguggucucuggccgccuucuuucuaagccggcagcugauuucaacuuuguauaccuaaccccucccauugagaggaccguuuaccggauggucgaccugcccgugcuacagccgcggcuguguacgcaugcucguuggccugccccggucuauggccucuugguagauccuucccucccauccaacccucaguggcagaauggcagagugcaugucaacgggacucuucuuggcacgacaccugugucuggcuccuggguuuccugcuuugcagcugaggccgccuacgaguuccaguccgggacuggcgagguggcgaccuucaccaugauugagcaggaugggucugccuauguccccggugauagggcggcuccccucggguaucccgacuucuccgggcaacuggagaucgaggugcagacugagaccaccaagucaggagauaaacucaaggugaccacuuuugagaugauccucgguccaaccaccaacgcggaccaagcccccuaccagggcagaguauacgcaagccuagcggcugcggccccgcucgaccugguggacgggaggguuagggcgguuccacgcucugucuauuucuuucaggaugugcucccagaguacaaugauggucuuuuaguuccccuugccccgccccuaggccccuuccuccccggugaggucuuguugagguuccggaccuacgugcgucagcuggacaccgcugacgccgcagcgcagccgaucgacugugccuugccccaggaguuuaucuccugguuugcaagcaacagcuucacgguucagucggaagcgcuccugaucagauaccggaacaccuugaccggccagcuccuguuugaggcuaagcucuauagcgaaggcuacauugcuguguccuacucgggaucugguccccucaccuucccuacugauggcuucuuugaggucgucagcugggucccccgccuuuuccaauuggccucugugggaagcuuggcaacaggccgaacacucaaacaauaa

SEQ ID NO: 6002 - RNA, 1626 nt, Artificial Sequence
  capsid_protein__Norovirus__ABU55586
augaggaugagugauggcgcagcgccaaaagccaacggcucugaagccaucggccaggaucuuguuccuaccgccguugaacaggccguccccauucagcccguggcuggcgcggcucuugccgcccccgccgccgggcaaaucaaccaaauugaccccuggaucuuccaaaauuuuguccaaugcccccuuggugaguuuuccauuucaccucgaaacaccccaggugagauacuguuugauuuggcccucgggccagggcucaaccccuaccuugcccaccucucagccauguacaccggcuggguugggaacauggagguucagcugguccucgccggcaaugccuuuacugcuggcaaggugguuguugcccuuguaccacccuauuuucccaaagggucacucaccacugcucagaucacaugcuucccacaugucaugugugaugugcgcgcccuggagcccauucaacucccucuucuugaugugcgucgaguucuuuggcaugcuacccaggaucaggaggagucuaugcgccugguuugcaugcuguacacgccacuccgcacaaacagcccgggugaugagucuuuuguggucucuggccgccuucuuucuaagccggcagcugauuucaacuuuguauaccuaaccccucccauugagaggaccguuuaccggauggucgaccugcccgugcuacagccgcggcuguguacgcaugcucguuggccugccccggucuauggccucuugguagacccuucccucccauccaacccucaguggcagaauggcagagugcaugucaacgggacucuucuuggcacgacaccugugucuggcuccuggguuuccugcuuugcagcugaggccgccuacgaguuccaguccgggacuggcgagguggcgaccuucaccaugauugagcaggaugggucugccuauguccccggugauagggcggcuccccucggguaucccgacuucuccgggcaacuggagaucgaggugcagacugagaccaccaagucaggagauaaacucaaggugaccacuuuugagaugauccucgguccaaccaccaacgcggaccaagcccccuaccagggcaaaguauaugcaagccuagcggcugcggccccgcucgaccugguggacgggaggguuagggcgguuccacgcucugucuauuucuuucaggaugugcucccagaguacaaugauggucuuuuaguuccccuugccccgccccuaggccccuuccuccccggugaggucuuguugagguuccggaccuacgugcgucagcuggacaccgcugacgccgcagcgcagccgaucgacugugccuugccccaggaguuuaucuccugguuugcaagcaacagcuucacgguucagucggaugcgcuccugaucagauaccggaacaccuugaccggccagcuccuguuugaggcuaagcucuauagcgaaggcuacauugcuguguccuacucggggucugguccccucaccuucccuacugauggcuucuuugaggucgucagcugggucccccgccuuuuccaauuggccucugugggaagcuuggcaacaggccgaacacucaaacaauaa

SEQ ID NO: 6003 - RNA, 1626 nt, Artificial Sequence
  capsid_protein__Norovirus__ABU55589
augaggaugagugauggcgcagcgccaaaagccaacggcucugaagccagcggccaggaucuuguuccuaccgccguugaacaggccguccccauucagcccguggcuggcgcggcucuugccgcccccgccgccgggcaaaucaaccaaauugaccccuggaucuuccaaaauuuuguccaaugcccccuuggugaguuuuccauuucaccucgaaacaccccaggugagauacuguuugaucuggcccucgggccagggcucaaccccuaccuugcccaccucucagccauguacaccggcuggguugggaacauggagguucagcugguccucgccggcaaugccuuuacugcuggcaaggugguuguugcccuuguaccacccuauuuucccaaagggucacucaccacugcucagaucacaugcuucccacaugucaugugugaugugcgcacccuggagcccauucaacucccucuucuugacgugcgucgaguucuuuggcaugcuacccaggaucaggaggaaucuaugcgccugguuugcaugcuguacacgccacuccgcacaaacagcccgggugaugagucuuuuguggucucuggccgccuucuuucuaagccggcagcugauuucaacuuuguauaccugaccccccccauugagaggaccgucuaccggauggucgaccugcccguacuacagccgcggcuguguacgcaugcucguuggccugccccggucuauggccucuugauagacccaucccucccauccaacccucaguggcagaauggcagagugcauguuaacgggacucuucuuggcacaacaccugucucuggcuccuggguuuccugcuuugcagcugaggccgccuacgaguuccaguccgggacuggcgagguggcgaccuucaccaugauugagcaggaugggucugccuauguccccggugacagggcggcuccccucggguaucccgacuucuccgggcaacuggagaucgaggugcagacugagaccaccaagucaggagauaaacucagggugaccacuuuugagaugauccucgguccuaccaccaacguggaccaagcccccuaccagggcagaguauacgcaagccuagcggcugcggccucgcucgaccugguggacggaaggguuagggcggucccacgcucugucuauuccuuucaggaugugcucccagaguacaaugauggccuuuuagucccccuugcuccgccccuaggccccuuucuccccggugaggucuuguugagguuccggaccuacaugcgucagcuggacaccgcugacgccgcagcgcagccgaucgacugugccuugccccaggaguuuaucuccugguuugcaagcaacaacuucacgguucagucggaugcgcuccugaucagauaccggaacacccugacuggccagcuccuguuugaggcuaagcucuauagcgaaggcuacauugcuguguccuauucgggaucugguccccucaccuucccuacugauggcuucuuugaggucgucagcugggucccccgccuuuuccaauuggccucugugggaagcuuggcaacaggccgaacacucaaacaguaa

SEQ ID NO: 6004 - RNA, 1626 nt, Artificial Sequence
  capsid_protein__Norovirus__ABU55598
augaggaugagugauggcgcagcgccaaaagccagcggcucugaagccagcggccaggaucuuguuccuaccgccguugaacaggccguccccauucagcccguggcuggcgcggcucuugccgcccccgccgccgggcaaauuaaccaaauugaccccuggauuuuccaaaauuuuguccaaugcccccuuggugaguuuuccauuucaccucgaaacaccccaggugaaauauuguuugauuuggcccucggaccaggacucaaccccuaccuugcccaccucucagccauguacaccggcuggguugggaacauggagguucagcugguccucgccggcaaugccuuuacugcuggcaaggugguuguugcccuuguaccacccuauuuucccaaagggucacucaccacugcucagaucacgugcuucccacaugucaugugugaugugcgcacccuggagcccauucaacucccucuucuugacgugcgucgaguucuuuggcaugcuacccaggaucaggaggaaucuaugcgccuggucugcaugcuguacacgccacuccgcacaaacagcccgggugaugagucuuuuguggucucuggccgccuucuuucuaagccggcagcugauuucaacuuuguauaccugaccccccccauugagaggaccauuuaucggauggucgacuugcccguguugcagccgcggcugugcacgcacgcucguuggccagccccggucuauggccucuuaguagauccaucccucccguccaauccccaauggcagaauggaagagugcauauugaugggacccuccuuggcacaacacccgucucugggucuuggguuuccugcuuugcagcugaggccgcauaugaguuccagucugggacgggugagguggcaacuuucacccugauugagcaggacggguccgccuacgucccuggugauagggcggccccucuugguuaccccgacuucucugggcaacuggagauugaggugcagacugagaccaccagggcaggugacaagcugaaggugaccaccuuugagaugauccuuggucccaccaccaacguggaccaagcgcccuaccagggcaggguauacgcuagccugacggcugcggccucccuugaccugguagauggcagaguuagggcaguuccacgcucuaucuauagcuuucaggaugugcuccccgaauauaaugauggucuuuugguuccccuugcccccccaauuggccccuuccuccccggugaagugcuucugagguuccgaaccuacaugcgccagguugacagcucugacgccgcagcagaggccauugacugcgcccuuccacaggaguucgucucgugguucgcgagcaacggauucacggugcagucggaggcccugcuccucagguacaggaacacccucacagggcaguugcuguuugagugcaagcucuacagcgaagguuauaucgcccuguccuauucgggcucaggaccgcucaccuucccaacugauggcuucuuugagguugucagcugggucccccgccuuuuucaauuggccucugugggaagcuugguaacaggccgaacacucaaacaguaa

SEQ ID NO: 6005 - RNA, 1626 nt, Artificial Sequence
  capsid_protein__Norovirus__ABU55601
augaggaugagugauggcgcagcgccaaaagccaacggcucugaagccagcggccaggaucuuguuccuaccgccguugaacaggccguccccauucagcccguggcuggugcggcucuugccgcccccgccgccgggcaaauuaaccaaauugaccccuggaucuuccaaaauuuuguccaaugcccccuuggugaguuuuccauuucaccucgaaacaccccaggugaaauauuguuugauuuggcccucgggccagggcucaaccccuaccuugcccaccucucagccauguacaccggcuggguugggaacauggagguucagcugguccucgccggcaacgccuuuacugcuggcaaggugguuguugcccuuguaccacccuauuuucccaaagggucacucaccacugcucagaucacaugcuucccacaugucaugugugaugugcgcacccuggagcccauucaacugccucuucuugacgugcgucgaguucuuuggcaugcuacccaggaucaggaggaaucuaugcgccuggucugcaugcuguauacgccacuccgcacaaacagcccgggugaugagucuuuuguggucucuggccgccuucuuucuaagccggcggcugauuucaacuuuguauaccugaccccccccauagagagaaccaucuaccggauggccgauuugcccguguuacagccgcggcugugcacgcacgcacguuggccugccccggucuauggccucuugguagacccaucucuccccucaaacccccaguggcagaauggaagagugcauguugaugggacccugcuuggcaccacuccgaucucugguucguggguguccugcuuugcggcagaggcugccuacgaguuccaaucgggcacgggugagguggcaacacucacccugauugagcaggauggcucugccuauguccccggcgacagggcagcgccacucgguuaccccgacuucuccggucaacuggagaucgagguccagaccgagaccaccaaggcuggagacaagcuuaagguaaccaccuuugacaugauucuggguccaaccaccaacguggaccaggcccccuaccagggcaggguguaugcuagcgucuccaccgcagcaucccuuggccugguggaugguaggguccgugcggucccgagguccauuuaugguuuucaggauacuaucccugaguauaaugaugggcuauugguuccccuugcccccccaauuggucccuuucuuccuggugagguucuccugagguuccggaccuacaugcgccagauugacaccgcugacgcugcggcagaggcgauagacugugcacucccccaggaguuuaucucuugguuugcguccaacgcguucaccgugcagucugaagcccugcuccuuagguauaggaacacccugacugggcaacugcuguuugagugcaaacucuacagcgaggguuacaucgccuugucuuauucaggaucaggaccccucacuuucccaacugacggcuucuuugaggccguuagcuggguuccccgccucuaucaauuggccucugugggaagcuuggcaacaggccgaacacucaaacaauaa

SEQ ID NO: 6006 - RNA, 1626 nt, Artificial Sequence
  capsid_protein__Norovirus__ABU55604
augaggaugagugauggcgcagcgccaagagccaacggcucugaagccaguggccaggaucuuguuccuaccgccguugaacaggccguccccauucagcccguggcuggugcggcucuugccgcccccgccgccgggcaaaucaaccaaauugaccccuggaucuuccaaaauuuuguccaaugcccccuuggugaguuuuccauuucaccucgaaacaccccaggugaaauauuguuugauuuggcccucgggccagggcucaaccccuaucuugcccaccucucagccauguauacuggcuggguugggaacauggagguucagcugguccucgccggcaaugccuuuacugcuggcaaggugguuguugcccuuguaccacccuauuuucccaagggaucacucaccaccgcccagaucacaugcuucccacaugucaugugugaugugcguacccuggagcccauucagcuuccccuucuugaugugcgucgaguccuuuggcaugcuacccaggaucaggaggaaucuaugcgccugguuugcaugcuguacacgccacuccgcacaaacagcccgggugaugagucuuuuguggucucuggccgccuucuuucuaagccggcggcugauuucaauuuugucuaccugacuccccccauagagagaaccaucuaucggauggucgacuugcccgugauacagccgcggcugugcacgcacgcacguuggccugccccgauuuauggucuccugguggacccaucccuccccucaaacccccaguggcagaauggaagagugcauguugauggaacccugcuuggcaccaccccaaucuccggcucauggguguccugcuuugcagcggaggcugccuaugaguuccagucagguaccggugagguggcgacauucacccugaucgagcaggaugggucugccuauguccccggugacagagcagcaccacucgguuaccccgacuucuccgggcagcuggagaucgagguccagaccgagaccaccaagacuggagacaaacucaaggucaccaccuuugagaugauucuuggcccaacgaccaacguggaccaggccccuuaccagggcaggguguacgccagcguugccgcugcggccucccucgaccugguggauggcaggguucgcgcggucccaagauccaucuaugguuuccaagauguuaucccugaauauaaugaugggcugcugguuccccuugcccccccaauuggucccuuucucccuggcgagguccuauugagguuccggaccuacaugcgucagcuugacaccgcugacgccgcagcagaggcgauagacugugcacuuccccaggaguuugucuccugguucgcgucuaacgcguucaccgugcagucugaggccuugcuccuuagguacaggaacacccugacugggcagcugcuguucgagugcaagcucuacagcgaagguuacaucgcccuguccuauuccggcucaggaccccucaccuucccggccgauggcuucuuugaggucgucagcugggucccucgccuuuaucaguuggccucugugggaagcuuggcaacaggccggaugcuuaggcaauaa

SEQ ID NO: 6007 - RNA, 1626 nt, Artificial Sequence
  capsid_protein__Norovirus__ABU55607
augaggaugagugauggcgcagcgccaaaagccaacggcucugaagccagcggccaagaucuuguuccuaccgccguugaacaggccguccccauucagcccguggcuggugcggcucuugccgcccccgccgccgggcaaaucaaccaaauugaccccuggaucuuccaaaauuuuguccaaugcccccuuggugaguuuuccauuucgccucgaaacaccccaggugaaauacucuuugauuuggcccucgggccagggcucaaccccuaccuugcccaccucucagccauguacaccggcuggguugggaacauggagguucagcugguccucgccggcaaugccuuuacugcuggcaaggugguuguugcccuuguaccacccuauuuccccaaagggucacucaccaccgcccagaucacaugcuucccacacgucaugugugaugugcguacccuggagcccauucaauugccucuucuugacgugcgucgaguucuuuggcaugcuacccaggaucaggaggaaucuaugcgccuggucugcaugcuguacacgccacuccgcacaaacagcccgggugaugagucuuuuguggucucuggccgccuucuuucuaagccggcaccugauuucaacuuuguauaccugacccccccuaucgagagaacuauuuaccggaugguugacuugcccguguugcagccgcggcugugcacgcacgcucguuggccggccccggucuauggccucuugguagacccaucccucccauccaauccccaguggcagaaugguagagugcaaguugaugggacucuucuugguacaacgccugugucugguucauggguuuccugcuuugcagcugaggcugccuacgaguuccaagcugggacuggugagguggugaccuucaccaugauugagcaggacggauccgccuauguccccggugacagggcggccccccuuggguaccccgacuucucugggcaacuggagaucgaggugcagacugagaccaccaaaacaggcgacaagcucagggugaccaccuucgagaugauccuuggccccaccaccaacguggaccaggcccccuaccagggcagagcguacgcgagcuuaacagcugcagccucgcuugaccugguggaugggagaguuagggcggucccacgcuccaucuauucuuuccaggaugagcucccagaguauaaugauggucuuuugguuccccuugccccaccccuaggccccuuucuuccuggugagguuuuguugagguuucguaccuacaugcgccagcuugacaccgcugacgccgcagcgcagccgaucgacugugccuugccccaggaguuuaucuccugguuugcaagcaacaacuucacgguccagucggacgcgcuccugguuagguaccggaauaccuugacuggccagcuccuguuugaggcuaagcuuuauagugaaggcuacauugcugugucuuacucagggucuggcccccucacuuuccccacugacggcuucuuugagguugucagcugggucccccgccucuuucaauuggccuccgugggaagcuugguaacaggccgaacacucaaacaauaa

SEQ ID NO: 6008 - RNA, 1626 nt, Artificial Sequence
  capsid_protein__Norovirus__ABU55610
augaggaugagugauggcgcagcgccaaaagccaacggcucugaagccagcggccaggaucuuguuccuaccgccguugaacaggccguccccauucagcccguggcuggcgcggcucuugccgcccccgccgccgggcaaauuaaccaaauugaccccuggaucuuccaaaauuuuguccaaugcccccuuggugaguuuuccguuucaccucgaaacaccccaggugaaauauuguuugaucuggcccucgggccagggcucaaccccuaccuugcccaccucucagccauguacaccggcuggguugggaacauggagguucagcugguccucgccggcaaugccuuuacugcuggcaaggugguuguugcccuuguaccacccuauuuucccaaagggucacucaccacugcucagaucacauguuucccacaugucaugugugaugugcgcacccuggagcccauucaacucccucuucuugaugugcgucgaguucuuuggcaugcuacccaggaucaggaggaaucuaugcgccuggucugcaugcuguacacgccacuccgcacaaacagcccgagugaugagucuuuuguggucucuggccgccuucuuucuaagccggcagcugauuucaauuuuguguaucugaccccccccauugagagaaccaucuaucggaugguugacuugcccguguugcagccgcggcugugcacgcacgcucguuggccagcaccggucuauggccucuugguggacccaucccucccguccaauccccaguggcagaauggaagagugcauguugaugggacccuucuugguacaacacccaucucuggauccuggguuuccugcuuugcagcugaggcugccuacgaguuccagucuggaacuggugagguggcgaccuucacccuuguugagcaggacggguccgccuaugucccuggugacagggcggccccucucggcuaccccgacuucuccgggcagcuggagaucgagguccagaccgagaccaccaagccuggagagaagcucaaggucaccaccuuugagaugauucuuggcccaacgaccaauguggaccaggcccccuaccgggguaagguguucgccagcaucaccaccgcggccucacuuagccugguggauggcaggguucgugcggucccaagauccaucuacaguuuccaagaugucaucccugaauacaaugaugggcuacugguuccccuugcccccccaauuggucccuuucuccccggugagguccucuugagguuccggaccuacaugcgucagcuugacagcgcugacgccgcagcagaggcgauagacugcgcacucccccaggaguuugucuccugguucgcgucuaacgcguucacugugcaguccgaggcccugcuccuuagguacaggaacacuuuaacugggcagcugcuguuugagugcaagcucuacagcgaggguuacaucgccuuguccuacuccggcucaggaccccucaccuucccgaccgauggcuucuuugagguugucagcuggguuccccgucuuuaucaauuggccuccgugggaagcuuggcaacaggccgaacccucaaacaauaa

SEQ ID NO: 6009 - RNA, 1626 nt, Artificial Sequence
  capsid_protein__Norovirus__ABU55613
augaggaugagugauggcgcagcgccaaaagccaacggcucugaagccagcggccaggaucuuguuccuaccgccguugaacaggccguccccauucagcccguggcuggcucggcucuugccgcccccgccgccgggcaaauuaaccaaauugacccuuggaucuuccaaaauuuuguccaaugcccccuuggugaguuuuccauuucaccucgaaacaccccaggugaaauacuguuugaucuggcccucgggccagggcucaaccccuaccuugcccaccucucagccauguacaccggcuggguugggaacauggagguucagcugguccucgccggcaaugccuuuacugcuggcaaggugguuguugcccuuguaccacccuauuuucccaaagggucacucaccacugcucagaucacaugcuucccacaugucaugugugaugugcgcacccuggagcccauucaacucccucuucuugacgugcgucgaguucuuuggcaugcuacccaggaucaggaggaaucuaugcgccuggucugcaugcuguauacgccacuccgcacaaacagcccgggugaugagucuuuuguggucucuggccgccuucuuucuaagccggcagcugauuucaacuuuguauaccugaccccccccauugagaggaccaucuaccggauggucgacuugcccgugcuacagccgcggcugugcacgcacgcucguuggccagccccgaucuauggccucuugguugacccaucccucccauccaacccccaauggcagaauggaagagugcauguugauggaacccuccuuggcacaacaccugucucuggauccuggguuuccugcuuugcagcugaggccgccuacgaguuccaauccgggacuggugagguggcaaccuucaccuugaucgagcaggauggguccgcuuaugucccuggugacagagcggccccacuuggcuaccccgauuuuucugggcaacuggagaucgaggugcagacugagacgaccaagacaggugauaagcugaaggugaccaccuuugagaugauccuuggucccacuaccaacguggaccaagcgcccuaccagggcaggguguacgccagccuaacggcuguggccucccuugaccugguugauggcagaguuagggcgguuccucgcuccaucuauggcuuucaggaugugauaccugaguauaaugauggccuucuugucccccuugcccccccaauuggccccuuucucccuggugagguucuccugagguuccggaccuacaugcgucagcuugacaccgcugaugccgcagcagaggcaauagacugugcacucccccaggaguucauuuccugguucgcguccaacgcguucaccgugcagucugaugcccuacuccuuagguauaggaacacccugacuggacagcugcuguuugagugcaagcucuacagcgaggguuacaucgcccuguccuacucggggucgggaccccucacuuucccaacugauggcuucuucgaggucgucaguugggucccccgccuuuuucaauuggccucugugggaagcuugacaacaggccgaacacuuaaacaauaa

SEQ ID NO: 6010 - RNA, 1626 nt, Artificial Sequence
  capsid_protein__Norovirus__ABU55616
augaggaugagugauggcgcagcgccaaaagccaacggcucugaagccagcggccaggaucuuguuccuaccgccauugaacaggccguccccauucagcccguggcuggcucggcucuugccgcccccgccgccgggcaaauuaaccaaauugacccuuggaucuuccaaaauuuuguccaaugcccccuuggugaguuuuccauuucaccucgaaacaccccaggugaaauacuguuugaucuggcccucgggccagggcucaaccccuaccuugcccaccucucagccauguacaccggcuggguugggaacauggagguucagcugguccucgccggcaaugccuuuacugcuggcaaggugguuguugcccuuguaccacccuauuuucccaaagggucacucaccacugcucagaucacaugcuucccacaugucaugugugaugugcgcacccuggagcccauucaacucccucuucuugacgugcgucgaguucuuuggcaugcuacccaggaucaggaggaaucuaugcgccuggucugcaugcuguauacgccacuccgcacaaacagcccgggugaugagucuuuuguggucucuggccgucuucuuucuaagccggcagcugauuucaauuuuguauaccugaccccccccauugagaggaccaucuaccggauggucgacuugcccgugcuacagccgcggcugugcacgcacgcucguuggccagccccgaucuauggccucuugguugacccaucccucccauccaacccccaauggcagaauggaagagugcauguugauggaacccuccuuggcacaacaccugucucuggauccuggguuuccugcuuugcagcugaggccgccuacgaguuccaauccgggacuggugagguggcaaccuucacuuugaucgagcaggauggguccgcuuaugucccuggugacagagcggccccacuuggcuaccccgauuuuucugggcaacuggagaucgaggugcagacugagacgaccaagacaggugauaagcugaaggugaccaccuuugagaugauccuuggucccacuaccaacguggaccaagcgcccuaccagggcaagguguacgccagccuagcgguugcggccucccuugaccugguugauggcagaguuagggcgguuccucgcuccaucuauggcuuucaggaugugauaccugaguauaaugauggucuucuuguuccccuugcccccccaauuggccccuuucucccuggugagauucuccugagguuccggaccuacaugcgucagcuugacaccgcugaugccgcagcagaggcaauagacugugcacucccccaggaguucauuuccugguucgcguccaaugcguucaccgugcaggcugaugcccuacuccuuagguauaggaacacccugacuggacagcugcuguuugagugcaagcucuacagcgaggguuacaucgcccuguccuacucggggucggcaccccucacuuucccaacugauggcuucuuugaggucgucaguugggucccccgccuuuuucaauuggccucugugggaagcuugacaacaggccgaacacuuaaacaauaa

SEQ ID NO: 6011 - RNA, 1626 nt, Artificial Sequence
  capsid_protein__Norovirus__ABU55619
augaggaugagugauggcgcagcgccaaaagccaacggcucugaagccagcggccaggaucuuguuccuaccgccguugaacaggccguccccauucagcccguggcuggcucggcucuugccgcccccgccgccgggcaaauuaaccaaauugacccuuggaucuuccaaaauuuuguccaaugcccccuuggugaguuuuccauuucaccucgaaacaccccaggugaaauacuguuugaucuggcccucgggccagggcucaaccccuaccuugcccaccucucagccauguauaccggcuggguugggaacauggagguucagcugguccucgccggcaaugccuuuacugcuggcaaggugguuguugcccuuguaccacccuauuuucccaaagggucacucaccacugcucagaucacaugcuucccacaugucaugugugaugugcgcacccuggagcccauucaacucccucuucuugacgugcgucgaguucuuuggcaugcuacccaggaucaggaggaaucuaugcgccuggucugcaugcuguauacgccacuccgcacaaacagcccgggugaugagucuuuuguggucucuggccgccuucuuucuaagccggcagcugauuucaauuuuguauaccugaccccccccaucgagaggaccaucuaccggauggucgacuugcccgugcuacagccgcggcugugcacgcacgcucguuggccagccccgaucuauggccucuugguugacccaucccucccauccaacccccaauggcagaauggaagagugcauguugauggaacccuccuuggcacaacaccugucucuggauccuggguuuccugcuuugcagcugaggccgccuacgaguuccaauccgggacuggucagguggcaaccuucaccuugaucgagcaggacggguccgcuuaugucccuggugacagagcggccccacuuggcuaccccgauuucuccgggcaacuggagaucgaggugcagacugagacgaccaaggcaggugauaagcugaaggugaccaccuuugagaugauccuuggucccacuaccaacguggaccaagcgcccuaccagggcaggguguacgccagccuagcgguugcggccucccuugaccugguugauggcagaguuagggcgguuccucgcuccauccauggcuuucaggaugugauaccugaguauaaugauggucuucuugucccccuugcccccccgauuggccccuuucucccuggugagguucuccugagguuccggaccuacaugcgccagcuugacaccgcugacgccgcagcagaggcaauagacugugcacucccccaggaguucauuuccugguucgcguccaacgcguucaccgugcagucugaugcccuacuccuuagguauaggaacacccugacuggacaguugcuguuugagugcaagcucuacagcgaggguuacaucgcccuguccuacucggggucgggaccccucacuuucccaacugauggcuucuuugaggucgucagcugggucccccgccuuuuucaauuggccucugugggaagcuuggcaacaggccgaacacuuaaacaauaa

SEQ ID NO: 6012 - RNA, 1626 nt, Artificial Sequence
  capsid_protein__Norovirus__ABU55622
augaggaugagugauggcgcaacgccaaaagccaacggcucugaagccagcggccaggaucuuguuccuaccgccguugaacaggccguccccauucagcccguggcuggcgcggcucuugccgcccccgccgcugggcaaauuaaccaaauugaccccuggaucuuccaaaauuuuguccaaugcccccuuggugaguuuuccauuucaccucgaaacaccccaggugaaauauuguuugaucuggcccuugggccagggcucaaccccuaccuugcccaccucucagccauguacaccggcuggguugggaacauggagguucagcugguccucgccggcaaugccuuuacugcuggcaaggugguuguugcccuuguaccacccuauuuucccaaggggucacucaccaccgcccagaucacauguuucccacaugucaugugugaugugcgcacccuggagcccauucaacucccucuucuugaugugcgucgaguucucuggcacgcuacccaggaucaagaggaaucuaugcgccugguuugcaugcuguacacgccacuccgcacaaacagcccgggugaugagucuuuuguggucucuggccgccuucuuucuaagccggcggcugauuucaauuuugucuaccugaccccccccauagagagaaccauuuaccgaauggucgacuugcccgugauacagccgcggcugugcacgcacgcacguuggccggccccggucuauggccucuugguggacccgucccuccccucgaacccccaguggcagaauggaagggugcacguugaugggacccugcuuggcaccaccccaauuuccggcucaugggugucuugcuuugcagcggaggcugccuaugaguuccaaucgggcaccggugagguggcgacauucacccugauugagcaagaugggucugccuauguccccggugauagggcagcaccacucgguuaccccgauuucuccgggcaacuggagaucgagguccagaccgagaccacuaagacuggagacaagcucaaggucaccaccuucgagaugauucuuggcccgacgaccaauguggaccaggcccccuaccagggcaggguguucgcgagcgucaccgccgcggccucucuugaccugguggauggcaggguucgugcggucccgagauccaucuacgguuuccaagauaccaucccugaguauaaugaugggcuacuggucccccuugcccccccaauuggucccuuccuccccggcgagguucuccugagguuccggaccuacaugcgucagcucgacacugcugacgccgcagcagaggcgauagacugcgcacucccccaggaguuugucuccugguucgcguccaacgcguucacugugcaguccgaggcccugcuccuuagguauaggaacacccugacugggcaauugcuguuugagugcaagcucuacagugaagguuacaucgcccuguccuauucgggcucagggucccucaccuucccgaccgacgguuucuuugaggucgucagcugggucccccgccuuuaucaauuggccucugugggaagcuuggcaacaggccgaacacucaaacaauaa

SEQ ID NO: 6013 - RNA, 1623 nt, Artificial Sequence
  capsid_protein__Norovirus__ABU55628
augaggaugagugauggcgcagugccaaaagccaacggcucugaagccagcggccaggaucuuguuccuaccgccguugaacaggccguccccauucagcccguggcuggugcgucuauugccgcccccgccgccgggcaaauuaaccaaauugaccccuggaucuuccaaaauuuuguccagugcccccuuggugaguuuuccauuucaccucgaaacaccccaggugaaauacuguuugauuuggcccucgggccagggcucaacccuuaccucgcccaccucucagccauguacacuggcuggguugggaacauggagguucagcugguccucgccggcaaugccuuuacugcuggcaaggugguuguugcccuuguaccacccuauuuucccaaagggucgcucaccacugcccagaucacaugcuucccacaugucaugugugaugugcgcacuuuggaacccauucaacucccucuucuugacgugcgucgaguucuuuggcaugcuacccaggaucaggaggaaucuaugcgccuggucugcaugcuguauacaccacuccgcacgaacaguccgggugaugagucuuuuguggucucuggccgccuucuuucuaagccggcagcugauuucaauuuuguauaccugaccccccccauugagagaacuauuuaccggauggucgauuugcccguguuacagccgcggcugugcacgcacgcucguuggccagcaccgauuuauggucucuugguggaucccucccucccauccaauccccaauggcagaauggaagagugcauguugauggaacccuccuuggcacaacaccuguuucuggguccugggucuccugcuuugcagcugaggccgccuacgaguuccaguccgggacuggugagguggcgacuuucacccugauugagcaagauggguccgcuuauguuccuggugacagagcggccccccuggguuaccccgacuucucuggacagcuggagauugaggugcagacugagacuaccaagacaggugaaaagcugaaggugaccacuuuugagaugauccuuggucccgccaccaacguggaccaggcgcccuuccaggguaggguguacgccagcuugacagcuguggccucccucgaccugguagauggcagaguuagagcggucccgcgcuccauuuaugcuuuccaggaugugaucccugaguauaaugauggucuucuuguuccccuugcccccccuauuggccccuuccuccccggugaguugcuuuugagguuccggaccuacaugcgccagaucgauaguucugacgcugcagcggaggccauugauugcgcccuuccacaggaguucaucucgugguucgcgagcaacgcguucacggugcagucggaggcccugcuccuuagauauaggaacacccugacugggcaguugcuguuugagugcaagcucuacagcgagggcuacaucgcucuguccuauucgggcucaggaccgcucaccuuuccggcugauggcuucuuugagguugucaguugggucccucgucuuuuccaauuggccucugugggaagcucggcaacaggccgaacacucaaauaa

SEQ ID NO: 6014 - RNA, 1593 nt, Artificial Sequence
  capsid_protein__Norovirus__ABW74121
augaugauggcgucuaaggacgcuacgucaagcguggauggcgccaguggcgcuggucaguugguaccggagguuaaugcuucugacccucuugcgauggauccuguagcgggcucuucaacagcaguugcaacugcugggcaaguuaacccuauugacccuuggauaaucaauaacuuugugcaggcuccccaaggugaauuuacuauuucuccaaauaauacccccggugauguuuuguuugauuugaguuuaggcccucaucuuaaucccuucuugcuacauuugucacaaauguauaauggcuggguuggcaauaugagaguuaggauuaugcuggcugguaaugcauuuacugcagguaaaauuauaguuucuugcauaccuccuggcuuugguucccauaaccuuacuauagcacaagcaacucuuuucccacaugugauugcugauguuaggacuuuagauccaauugaaguacccuuagaagauguaaggaauguucucuuucauaauaaugacagaaaucaacaaacaaugcgccuugugugcaugcuuuacaccccccuccgcacugguagcgguacaggugauucuuuugugguugcagggcgaguuaugacuuguccuagccccgauuuuaauuucuuauuuuugguuccucccacaguggaacagaagaccaggccuuuuacucucccaaauuuaccgcugaguucuuugucaaauucacgugcuccucuuccaauuaguggcauggguauuucuccagauaauguucagagugugcaguuccaaaauggccgguguaccuuagaugggcgacuuguuggcaccaccccagucucccucucccauguugcuaagauaagggguacuucuaauggcacugugaucaaucucaccgaauuggauggcacccccuuccacccuuuugaaggcccugccccuauugguuucccagaucuugguggcugugauuggcauauuaacaugacacaauuuggacauucuagccagacucaguaugauguggauaccacccccgacaccuucgucccccacuuagguucaauccaggcgaauggcaucaauaguggcaacuacauugguguucuuagcugggucucccccccaucacacccaucuggcucucaaguugaucuuuggaagauccccaacuaugggucuagcaucacagaggcaacccaucuagcucccucugucuuuccuccugguuuuggagagguacuagucuuuuucaugucaaagauaccagguccuggugcuuauagucuacccuguuuacugccacaagaauauauuucacaccuugcaagugaacaagcccccacuguuggugaggccgcccugcuccacuauguugacccugauacaggccggaaucuuggggaguuuaaggcuuacccugaugguuuccuaaccugugucccuaauggggccagcucgggcccacaacaacugccaaucaauggagucuuugucuuuguuucauggguguccagauuuuaucaguuaaagccugugggaacugccagcacggcaagagguaggcuugguuugcgccgauaa

SEQ ID NO: 6015 - RNA, 1593 nt, Artificial Sequence
  capsid_protein__Norovirus__ABW74123
augaugauggcgucuaaggacgcuacgucaagcguggauggcgccaguggcgcuggucaguugguaccggagguuaaugcuucugacccucuugcaauggauccuguagcgggcucuucaacagcaguugcaacugcugggcaaguuaacccuauugacccuuggauaaucaauaacuuugugcaggcuccccaaggugaauuuacuauuucuccaaauaauacccccggugauguuuuguuugauuugaguuuaggcccucaucuuaaucccuucuugcuacauuugucacaaauguauaauggcuggguuggcaauaugagaguuaggauuaugcuggcugguaaugcauuuacugcagguaaaauuauaguuucuugcauaccuccuggcuuugguucccauaaccuuacuauagcacaagcaacucuuuucccacaugugauugcugauguuaggacuuuagauccaauugaaguacccuuagaagauguaaggaauguucucuuucauaauaaugacagaaaucaacaaacaaugcgccuugugugcaugcuuuacaccccccuccgcacugguggcgguacaggugauucuuuugugguugcagggcgaguuaugacuuguccuagccccgauuuuaauuucuuauuuuugguuccucccacaguggaacagaagaccaggccuuuuacucucccaaauuuaccgcugaguucuuugucaaauucacgugcuccucuuccaauuaguggcauggguauuucuccagauaauguucagagugugcaguuccaaaauggccgguguaccuuagaugggcgacuuguuggcaccaccccagucucccucucccauguugcuaagauaagggguacuucuaauggcacugugaucaaucucaccgaauuggauggcacccccuuccacccuuuugaaggcccugccccuauugguuucccagaucuugguggcugugauuggcauauuaacaugacacaauuuggacauucuagccagacucaguaugauguggauaccacccccgacaccuucgucccccacuuagguucaauccaggcgaauggcaucaauaguggcaacuacauugguguucuuagcugggucucccccccaucacacccaucuggcucucaaguugaucuuuggaagauccccaacuaugggucuagcaucacagaggcaacccaucuagcucccucuguuuuuccuccugguuuuggagagguacuagucuuuuucaugucaaagauaccagguccuggugcuuauagucuacccuguuuacugccacaagaauauauuucacaccucgcaagugaacaagcccccacuguuggugaggccgcccugcuccacuauguugacccugauacaggccggaaucuuggggaguuuaaggcuuacccugaugguuuccuaaccugugucccuaauggggccagcucgggcccacaacaacugccaaucaauggagucuuugucuuuguuucauggguguccagauuuuaucaguuaaagccugugggaacugccagcacggcaagagguaggcuugguuugcgccgauaa

SEQ ID NO: 6016 - RNA, 1593 nt, Artificial Sequence
  capsid_protein__Norovirus__ABW74124
augaugauggcgucuaaggacgcuacgucaagcguggauggcgccaguggcgcuggucaguugguaccggagguuaaugcuucugacccucuugcaauggauccuguagcgggcucuucaacagcaguugcaacugcugggcaaguuaacccuauugacccuuggauaaucaauaacuuugugcaggcuccccaaggugaauuuacuauuucuccaaauaauacccccggugauguuuuguuugauuugaguuuaggcccucaucuuaaucccuucuugcuacauuugucacaaauguauaauggcuggguuggcaauaugagaguuaggauuaugcuggcugguaaugcauuuacugcagguaaaauuauaguuucuugcauaccuccuggcuuugguucccauaaccuuacuauagcacaagcaacucuuuucccacaugugauugcugauguuaggacuuuagauccaauugaaguacccuuagaagauguaaggaauguucucuuucauaauaaugacagaaaucaacaaacaaugcgccuugugugcaugcuuuacaccccccuccgcacugguggcgguacaggugauucuuuugugguugcagggcgaguuaugacuuguccuagccccgauuuuaauuucuuauuuuugguuccucccacaguggaacagaagaccaggccuuuuacucucccaaauuuaccgcugaguucuuugucaaauucacgugcuccucuuccaauuaguggcauggguauuucuccagauaauguucagagugugcaguuccaaaauggccgguguaccuuagaugggcgacuuguuggcaccaccccagucucccucucccauguugcuaagauaagggguacuucuaauggcacugugaucaaucucaccgaauuggauggcacccccuuccacccuuuugaaggcccugccccuauugguuucccagaucuugguggcugugauuggcauauuaacaugacacaauuuggacauucuagccagacucaguaugauguggauaccacccccgacaccuucgucccccacuuagguucaauccaggcgaauggcaucaauaguggcaacuacauugguguucuuagcugggucucccccccaucacacccaucuggcucucaaguugaucuuuggaagauccccaacuaugggucuagcaucacagaggcaacccaucuagcucccucugucuuuccuccugguuuuggagagguacuagucuuuuucaugucaaagauaccagguccuggugcuuauagucuacccuguuuacugccacaagaauauauuucacaccucgcaagugaacaagcccccacuguuggugaggccgcccugcuccacuauguugacccugauacaggccggaaucuuggggaguuuaaggcuuacccugaugguuuccuaaccugugucccuaauggggccagcucgggcccacaacaacugccaaucaauggagucuuugucuuuguuucauggguguccagauuuuaucaguuaaagccugugggaacugccagcacggcaagagguaggcuugguuugcgccgauaa

SEQ ID NO: 6017 - RNA, 1593 nt, Artificial Sequence
  capsid_protein__Norovirus__ABW74125
augaugauggcgucuaaggacgcuacgucaagcguggauggcgccaguggcgcuggucaguugguaccggagguuaaugcuucugacccucuugcaauggauccuguagcgggcucuucaacagcaguugcaacugcugggcaaguuaacccuauugacccuuggauaaucaauaacuuugugcaggcuccccaaggugaauuuacuauuucuccaaauaauacccccggugauguuuuguuugauuugaguuuaggcccucaucuuaaucccuucuugcuacauuugucacaaauguauaauggcuggguuggcaauaugagaguuaggauuaugcuggcugguaaugcauuuacugcagguaaaauuauaguuucuugcauaccuccuggcuuugguucccauaaccuuacuauagcacaagcaacucuuuucccacaugugauugcugauguuaggacuuuagauccaauugaaguacccuuagaagauguaaggaauguucucuuucauaauaaugacagaaaucaacaaacaaugcgccuugugugcaugcuuuacaccccccuccgcacugguggcgguacaggugauucuuuugugguugcagggcgaguuaugacuuguccuagccccgauuuuaauuucuuauuuuugguuccucccacaguggaacagaagaccaggccuuuuacucucccaaauuuaccgcugaguucuuugucaaauucacgugcuccucuuccaauuaguggcauggguauuucuccagauaauguucagagugugcaguuccaaaauggccgguguaccuuagaugggcgacuuguuggcaccaccccagucucccucucccauguugcuaagauaagggguacuucuaauggcacugugaucaaucucaccgaauuggauggcacccccuuccacccuuuugaaggcccugccccuauugguuucccagaucuugguggcugugauuggcauauuaacaugacacaauuuggacauucuagccagacucaguaugauguggauaccacccccgacaccuucgucccccacuuagguucaauccaggcgaauggcaucaauaguggcaacuacauugguguucuuagcugggucucccccccaucacacccaucuggcucucaaguugaucuuuggaagauccccaacuaugggucuagcaucacagaggcaacccaucuagcucccucugucuuuccuccugguuuuggagagguacuagucuuuuucaugucaaagauaccagguccuggugcuuauagccuacccuguuuacugccacaagaauauauuucacaccucgcaagugaacaagcccccacuguuggugaggccgcccugcuccacuauguugacccugauacaggccggaaucuuggggaguuuaaggcuuacccugaugguuuccuaaccugugucccuaauggggccagcucgggcccacaacaacugccaaucaauggagucuuugucuuuguuucauggguguccagauuuuaucaguuaaagccugugggaacugccagcacggcaagagguaggcuugguuugcgccgauaa

SEQ ID NO: 6018 - RNA, 1593 nt, Artificial Sequence; identical to SEQ ID NO: 6016
  capsid_protein__Norovirus__ABW74126

SEQ ID NO: 6019 - RNA, 1593 nt, Artificial Sequence; identical to SEQ ID NO: 6016
  capsid_protein__Norovirus__ABW74127

SEQ ID NO: 6020 - RNA, 1593 nt, Artificial Sequence; identical to SEQ ID NO: 6016
  capsid_protein__Norovirus__ABW74128

SEQ ID NO: 6021 - RNA, 1620 nt, Artificial Sequence
  capsid_protein__Norovirus__ABW74532
augaagauggcgucgagugacgccaacccaucugauggguccgcagccaaccucgucccagaggucaacaaugagguuauggcucuggagcccguuguuggugccgcuauugcggcaccuguggcgggccaacaaaacauaauugaccccuggauuagaaauaauuuuguacaagccccugguggugaguucacgguguccccuagaaacgcuccaggugagauacuguggagugcacccuugggcccugauuugaaccccuaucuuucucaucugucuagaauguauaaugguuaugcagguggcuuugaagugcaaguaauccucgcggggaacgcguucaccgccgggaagaucauauuugcagcaguuccaccaaacuuuccaacugaaggcuuaagccccagccagguuacuauguucccucauguaauuguagauguuaggcaauuggaaccuguguugauuccccuaccugauguuaggaauaauuucuaucacuauaaucaagcacaugauccuaccauuaaguugauagcaauguuguacacaccacuuagggcuaauaaugccggggaugaugucuucacagucucuugucgaguccucacgaggccaucccccgauuuugauuuuauauuccuugugccacccacaguugaaucaagaaccaaaccauuuaccgucccaauuuuaaccguugaggaaaugucuaacucaagauuccccauuccuuuggaaaaguuguacacgggucccagcagugauuuuguuguccaaccacaaaauggcagguguacgacugacggcguacuuuuaggcaccacucagcugucagcuguuaacaucuguaacuuuaagggggaugucacccauauugcgggcagccgugacuauagaaugaaucuggugucccaaaauuggaacaauuaugacccaacagaagaaaucccagccccccugggaacaccagauuuccaggggaagauccaaggccugcucacccagacaacaggagcugauggcucgacccgugcccacaaggccacagugagcacuggggccgccaacuucacuccaaagcuggguaguguucaauucaccacugacacagauaaugauuuccaaacuggccaaaacacaaaauucaccccaguuggcgucauccaagacggcagucaccaucagaaugaaccccaacaauggguacucccaaauuacucagguagaacugugcacaacgugcaccuggccccugccguugcccccacuuuuccgggugagcaacuccuuuucuucagguccacuaugcccggaugcagcggguaccccaacaugaaccuggacugucuacucccccaggaaugggugaugcacuucuaccaggaagcagccccagcacaaucugauguggcucuguugagauuuguuaauccagacacaggcaggguucuguuugaguguaagcuccauaaagcaggcuauaucacaguggcucacacuggucagcaugauuugguuaucccccccaaugguuauuucagauuugauuccugggucaaccaguucuacacacuugcccccaugggaaauggagcggggcgcaggcgcgcauuauaa

SEQ ID NO: 6022 - RNA, 1620 nt, Artificial Sequence
  capsid_protein__Norovirus__ABW74533
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuaggaacgcuccgggugagauacuauggagcgcgcccuugggcccugauuugaaccccuaccuuucucauuuggccagaauguacaaugguuaugcaggugguuuugaagugcagguaauccucgcggggaacgcguucaccgccgggaaaaucauauuugcagcagucccaccaaauuuuccaacugaaggcuugagccccagccagguuacuauguucccccauauaauaguagauguuaggcaauuggaaccuguguugauccccuuaccugauguuaggaauaauuucuaucauuacaaucaaucaaaugauucuaccauuaaauugauagcaaugcuguauacaccacuuagggcuaauaaugcuggggaugaugucuucacagucucuugucgaguccucacgaggccaucccccgauuuugauuucauauucuuggugccacccacaguugaaucaagaacuaaaccauucaccguuccaaucuuaacuguugaggaaauguccaauucaagauuccccauuccuuuggaaaaguuauacacgggucccagcagugcuuuuguuguccaaccacaaaauggcaggugcacgacugauggcgugcucuuaggcacuacccagcugucugcugucaacaucugcaccuucagaggggaugucacccacauugcaggcagucaugauuauacaaugaauuuggcuucucaaaauuggaacaauuaugacccaacagaagaaaucccagccccucugggaacuccagauuucgugggaaagauccaaggcaugcucacccaaaccacaagaggggauggcucgacccgcgcccacaaagcuacagugagcacugggaguguccacuuuacuccaaagcugggcaguguucaauucaccacugacacaaacaaugauuuucaaacuggccaaaacacgaaauucaccccagucggcgucauccaggacggugauaaccaucaaaaugaaccccaacaauggguacucccaaauuacucagguagaacuggucauaaugugcaccuagccccugccguugcccccacuuuuccgggugagcaacuucuuuucuuuagguccacuaugcccggauguagcggguaucccaacaugaaucuggauugccuacucccccaggaaugggugcagcacuucuaccaagaagcagcuccagcacaaucugauguggcucugcugagauuugugaauccagacacagguaggguucuguuugagugcaagcuccauaaaucaggcuaugucacaguggcucacacuggcccgcaugauuugguuaucccccccaaugguuacuuuagauuugauuccugggucaaccaguucuacacacuugcccccaugggaaaugggacggggcguagacgugcauuauaa

SEQ ID NO: 6023 - RNA, 1623 nt, Artificial Sequence
  capsid_protein__Norovirus__ABW74534
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuuggguccugaucugaaucccuaccuuucucauuuggccagaauguacaaugguuaugcaggugguuuugaggugcagguaauccucgcggggaacgcguucaccgccgggaaaaucauauuugcagcaguuccaccaaauuuuccaacugaaggcuugagccccagccaggucacuauguucccccauauaauaguagauguuaggcaacuggaaccuguguugauccccuuaccugauguuaggaauaauuucuaucacuauaaucaaucaaaugacccuaccauuaaauugauagcaaugcuguacacaccacuuagggcuaauaaugcuggggacgaugucuucacagucucuugucgaguccucacgaggccaucccccgauuuugauuucauauuuuuggugccacccacaguugagucaagaacuagaccauucaccgucccaauuuuaacuguugaggaaaugaccaauucaagauuccccauuccuuuggaaaaguuauucacgggucccagcggugccuuuguuguucaaccacaaaauggcaggugcacgacugauggcgugcucuuaggcacuacccaacugucuccugucaacaucugcaccuucagaggggaugucacccacauugcaggcacucaugauuacacaaugaauuuggcuucucaaaauuggaacaauuaugacccaacagaagaaaucccagccccucugggaacuccagauuucgugggaaagauccaaggcgugcucucccaaaccacaaggggggacggcucgacccgcggccacaaagcuacagugagcacugggaguguccacuucacuccaaagcugggcaguguucaguucaccacugauacaaacaaugaucuugaaacuggccaaaacacgaaauucaccccagucggugucguccaggaugguaacaguacccaccaaaaugaaccccaacaaugggugcucccaaauuacucagguagaacuggucauaauguacaccuagccccugccguagcccccacuuuuccgggugagcaacugcuuuucuucagguccacuaugcccggaugcagcggguaucccaacaugaauuuggauuguuuacucccacaggaaugggugcagcacuucuaucaagaggcagcuccagcacaaucugauguggcucugcugagauuugugaauccagacacagguaggguucuguuugagugcaagcuucauaaaucaggcuaugucacgguggcucacacuggccaacaugauuuggucaucccccccaauggcuacuuuagauuugauuccugggucaaccaauucuacacacuugcccccaugggaaauggagcggggcguagacgugcacuauaa

SEQ ID NO: 6024 - RNA, 1623 nt, Artificial Sequence
  capsid_protein__Norovirus__ABW74535
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucacuacaaucaaucaaaugaccccaccauuaaauugauagcaaugcuguauacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggagaugaccaauucaagauuccccauuccuuuggaaaaguuguucacggguccuagcggugccuuuguuguucaaccacaaaauggcaggugcacgacugauggcgugcucuuaggcacuacccaacugucuccugucaacaucugcaccuucagaggggaugucacccacauugcagguacucauaauuacacaaugaauuuggcuucucaaaauuggaacaauuaugacccaacagaagaaaucccagccccucuggggaccccagauuuugugggaaggauccaaggcaugcucacccaaacuacaaggggggauggcucuacccgcggccacaaagcuacagugagcacuggggauguccacuucacuccaaagcugggcaguauucaguucaacacugauacaaacaaugauuuugaaacuggccaaaacacgagauucaccccagucgguguuguccaggaugguaaugguacccaccaaaaugaaccccaacaaugggugcucccaagcuacucagguagaacuggucauaauguacaccuagcccccgccguagcccccacuuuuccgggugagcaacuucuuuucuucagguccacuaugcccggaugcagcggguaccccaacaugaauuuggauugucuacucccccaggaaugggugcagcacuucuaccaagaggcagcuccagcacaaucugauguggcucugcuaagauuugugaauccagacacagguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacgugcauuauaa

SEQ ID NO: 6025 - RNA, 1620 nt, Artificial Sequence
  capsid_protein__Norovirus__ABW74536
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguuuccccuaggaacgcuccgggugagauacuauggagcgcgcccuugggcccagauuugaaccccuaucuuucucauuuggccagaauguacaaugguuaugcaggugguuuugaagugcagacaauccucgcggggaacgcguucaccgccgggaaaaucauauuugcagcagucccaccaaauuuuccaacugaaggcuugagccccagucaaguuacuauguucccccacauaauaguagauguuaggcaauuggaaccuguguugauccccuuaccugauguuaggaauaacuucuaucauuauaaucaaucaaaugauccuaccauuaaauugauagcaaugcuguauacaccacuuagggcuaauaaugcuggggaugaugucuucacagucucuugucgaguccucacgaggccaucccccgauuuugauuuuauauuccuggugccacccacaguugaaucaagaacuaaaccauucaccgucccaaucuuaacaguugaggaaauguccaauucaagauuccccauuccuuuggaaaaguuguacacgggucccagcagugcuuuuguuguccaaccacaaaauggcaggugcacgacugauggcgugcucuuaggcacuacccagcugucugcugucaacaucugcaccuucagaggggaugucacccacauugcaggcagucacgacuacacaaugaauuuggcuucucaaaauuggaacaauuaugacccaacggaagaaaucccagccccucuggggacuccagauuuugugggaaagauccaaggcaugcucacccaaaccacaagagaggauggcucgacccgcgcccacaaagcuacagugagcacugggaguguccacuuuacuccaaagcugggcaguguucaauacaccacugacacaaacaaugauuuucaagcuggccaaaacacgaaauucaccccagucggugucauccaggacgguaauaaccaccagaaugaaccccaacaauggguacucccaaacuacucagguagaacuggucauaaugugcaccuagcuccugccguugcccccacuuucccgggugagcaacuucuuuucuuuagguccacuaugcccggauguagcggguaccccaacaugaaucuggauugccuacucccccaggagugggugcagcacuuuuaccaagaagcagcuccagcacagucugauguggcuuugcugagauuugugaauccagacacagguaggguucuguuugagugcaaacuccauaaaucaggcuaugucacaguggcucacacuggcccgcaugauuugguuaucccccccaaugguuacuuuagauuugauuccugggucaaccaauucuacacgcuugcccccaugggaaauggaacggggcguagacgugcauuauaa

SEQ ID NO: 6026 - RNA, 1623 nt, Artificial Sequence
  capsid_protein__Norovirus__ABW74537
augaagauggcgucgaaugacgccagcccaucugauggguccacagccaaccucgucccagaggucaacaaugagguuauggcuuuggagcccguuguuggugccgccauugcggcaccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaauccauaccuuucucaccuggccagaauguacaaugguuaugcaggugguuuugaagugcaggugauccucgcggggaacgcguucaccgccgggaaaaucauauuugcagcagucccaccaaauuucccaacugaaggcuugagccccagccaggucacuauguucccccauauaauaguagauguuaggcaauuggaaccuguguugauccccuuaccugauguuaggaauaauuucuaccacuacaaucaaucaaaugaccccaccauuaaauugauagcaaugcuguacacaccacuuagggcuaauaaugcuggggaugaugucuucacagucucuugucgaguccucacgaggccaucccccgauuuugauuucauauuucuggugccacccacaguugagucaagaaccaaaccauucaccgucccaauuuuaacuguugaggaaaugaccaauucaagauuccccauuccuuuggaaaaauuguucacgggucccagcagugccuuugucguccaaccacagaauggcaggugcacgacugauggcgugcucuugggcacuacccaacugucccccgucaacaucugcaccuucagaggggaugucacccacauuccagguacucguacuuacagaaugaauuuggcuucucaaaauuggaacaauuaugacccaacagaagaaaucccagccccucugggaacuccagauuucgugggaaagauccaaggcaugcucacccaaaccacaaagggagacggcucgacccgcggucacaaagcuacagugagcacugggagugucgacuucacuccaaagcugggcagcguucaguucgccacugauacagacaaugauuuugaaacuggccaaaacacaagguucaccccagucggugucauccaggaugguaguagugcccacagaaaugaaccccaacaauggguacucccagauuacucagguagaacuguucauaauguacaccuagccccugccguagcccccacuuuuccgggugagcaacuucuuuucuucagaucuacuaugcccggaugcaguggguaucccaauauggauuuggauugccuacucccccaggaaugggugcagcacuucuaccaagaggcagcuccagcacaaucugauguggcuuugcugagauucgugaauccagacacagguaggguucuguuugagugcaagcuucauaaaacaggcuaugucacaguggcucacacuggccagcaugauuugguuaucccccccaauggcuacuuuagauuugauuccugggucaaccaguucuacacacuugcccccaugggaaauggagcggggcguagacgugcauuauaa

SEQ ID NO: 6027 - RNA, 1623 nt, Artificial Sequence
  capsid_protein__Norovirus__ABW74538
augaagauggcgucgaaugacgccagcccaucugauggguccacagccaaccucgucccagaggucaacaaugagguuauggcuuuggagcccguuguuggugccgcaauugcggcaccuguagcgggccaacaaaauguaauugaccccuggauuagaaguaauuuuguacaagccccugguggagaguucacaguauccccuagaaacgcuccaggugaaauacuauggagcgcgcccuugggcccugaucugaaucccuaccuuucucauuuggccagaauguacaaugguuaugcaggugguuuugaagugcagguaauucucgcggggaaugcguuuaccgccgggaaaaucauauuugcagcaguuccaccaaauuucccaacugaaggcuugagccccagccaggucacuauguucccccauauaauaguagauguuaggcaacuggaaccuguguugauccccuuaccugauguuaggaauaauuucuaucacuauaaucaguugaaugaccccaccauuaagcugauagcaaugcuguauacaccacuuagggccaauaaugcuggggacgaugucuucacagucucuugucgaguccucacgaggccaucccccgauuuugauuucauauuuuuggugccacccacaguugagucaagaacuaagccauucaccgucccaauuuugacuguugaggaaaugaccaauucaagauuccccauuccuuuggaaaaguuauucacgggucccaguggugccuuuguuguucaaccacaaaauggcagaugcacgacugauggcgugcucuuaggcacuacccagcugucuccugucaacaucugcaccuucagaggggaugucacccacauugcagguacucaugauuacacaaugaauuuggcuucucaaaauuggaacaacuacgacccaacagaagaaaucccagccccucugggaaccccagauuucgugggaaagauccaaggcgugcucacucaaaccacaaggggagauggcucgacccguggccacaaagcuacagugagcacugggaguguccacuuuacuccaaagcugggcaguguucaauucaccacugauacaaacaaugaucuugaaacuggccaaaacacgagauucaccccagucggugucguccaggaugguaauaguacccaccaaaaugaaccccaacaaugggugcucccaaauuacucagguagagcuggccacaauguacaccuagccccugccguagcccccacuuuuccgggcgagcaacuucuuuucuucagguccacuaugcccgggugcagcggguaucccaacaugaauuuggauugccuacuuccccaggaaugggugcagcacuucuaccaagaggcagcuccagcacaaucugacguggcucugcuaagauuugugaauccagacacagguaggguccuguuugagugcaaacuucauaaaucagguuaugucacaguggcucacacuggccagcaugauuugguuaucccccccaauggcuauuuuagauuugauuccugggucaaccaauucuacacacuugcccccaugggaaauggagcggggcgccggcgugcguuguaa

SEQ ID NO: 6028 - RNA, 1623 nt, Artificial Sequence
  capsid_protein__Norovirus__ABW74539
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucauuuggccagaauguacaaugguuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaauaauuucuaucacuacaaccaaucaaaugacuccaccauuaaauugauagcaaugcuguacacaccacuuagggcuaauaaugcuggggacgaugucuucacagucucuugucgaguccucacgaggccaucccccgauuuugauuucauauuuuugguaccacccacaguugagucaagaacuaaaccauucaccgucccaauuuuaacuguugaggaaaugaccaauucaagauuccccauuccuuuggaaaaguuguucacggguccuagcggugccuuuguuguucaaccacaaaauggcaggugcacgacugauggcgugcucuuaggcacuacccaacugucuccugucaacaucugcaccuucaggggggaugucacccacauugcaggcacucgaaauuacacaaugaauuuggcuucucaaaauuggaacaauuaugacccaacagaagaaaucccagccccucuggggaccccagauuucgugggaaggauccaaggcaugcucacccaaacuacaaggagggaugguucuacccgcggccacaaagcuacagugagcacuggggaugcccacuucacuccaaagcugggcaguauuauguucagcacugauacagacaaugauuuugaaacuggccaaaacacaaaauucaccccagucgguguuguucaggaugguaauggcacccaccaaaaugaaccccaacaaugggugcucccaagcuacucagguagaacuggucauaauguacaccuagcccccgccguagcccccacuuuuccgggugagcaacuucuuuucuucaggucuacuaugcccggaugcagcggguaccccaacaugaauuuggauugucuacucccccaggaaugggugcagcacuucuaccaagaggcagcuccagcacaaucugauguggcucugcuaagauuugugaauccagacacagguaggguucuauuugagugcaagcuucauaaaucagguuaugucacaguggcucacacuggccagcaugauuugguuaucccccccaauggcuacuuuagauuugauuccugggucaaccaauucuacacacuugcccccaugggaaaugggacggggcguaggcgugcauuauaa

SEQ ID NO: 6029 - RNA, 1623 nt, Artificial Sequence
  capsid_protein__Norovirus__ABW74540
augaagauggcgucgaaugacgccaccccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguucacaguauccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuuuccaacugaaggcuugagccccagccaggucacuauguucccccauauaauaguagauguuaggcaacuggaaccuguguugauccccuugccugauguuaggaacaauuucuaucauuacaaucaaucaaaugaccccaccaucaaauugauagcaaugcuguauacaccacuuagggcuaacaaugcuggggacgaugucuucacagucucuugucgaguucucacgagaccaucccccgauuuugauuucauauuucuggugccacccacaguugagucaagaacuaaaccauucucugucccaaucuuaacuguugaggagaugaccaauucaagauucccuauuccuuuggaaaaguuguucacgggucccagcagugccuuuguuguucaaccacaaaauggcagaugcacgacugauggcgugcucuuagguacuacccaacugucuccugucaacaucugcaccuucagaggggaugucacccacauugcagguacucaaaauuacacaaugaaucuggccucccaaaauuggaacaauuaugacccaacagaagaaaucccagccccucugggaaccccagauuuuguaggaaagauccaaggcgugcucacccaaaccacaaggagggauggcucgacccguggucacaaagccacagugagcacuggaaguguccacuucaccccaaaguugggcaguguucaauucuccacugauacaagcaaugacuuugaaacuggccaaaacacgagauucaccccagucggugucguccaggaugguaguaccacccaccaaaaugaaccccaacaaugggugcucccagauuauucagguagagauagucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacaggcaggguuuuguuugagugcaagcuucauaaaucagguuauguaacaguggcucacacuggccaacaugauuugguuaucccccccaauggcuauuuuagauuugauuccugggucaaccaauucuacacacuugcccccaugggaaauggagcggggcguagacgugcauuauaa

SEQ ID NO: 6030 - RNA, 1623 nt, Artificial Sequence
  capsid_protein__Norovirus__ABW74541
augaagauggcgucgaaugacgccaccccaucugauggguccacagccaaccucgucccagaggucaauaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcaggugauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugaucccccugccugauguuaggaacaauuucuaucauuacaaucaaucuaaugaccccaccaucaaauugauagcaaugcuguauacaccacuuagggcuaacaaugcuggggacgaugucuucacagucucuugucgaguucucacgagaccauccccugauuuugauuucauauuuuuggugccacccacaguugagucaagaacuaaaccauucucugucccaaucuuaacuguugaggagaugaccaauucaagauucccuauuccuuuggaaaaguuguucacgggucccagcagcuccuuuguuguucaaccacaaaauggcagaugcacgacugauggcgugcucuuagguacuacccagcugucuccuguuaacaucugcaccuucagaggggaugucacccacauugcagguacucaaaauuacacaaugaaucuggccucccaaaauuggaacaauuaugacccaacagaagaaaucccagccccucugggaaccccagauuuuguaggaaagauccaaggcgugcucacccaaaccacaaggggggauggcucgacccgcggucauaaagccacagugagcacuggaaguguccacuuuacuccaaagcugggcaguguucaauucuccacugauacaagcaaugacuuugaaacuggccaaaacacgagauucaccccagucggugucguccaggaugguaguaccacccaccaaaaugaaccccaacaaugggugcucccagacuauucagguagaaauagucacaauguacaccuagccccugcuguggcccccacuuuuccgggugagcaacuucuuuucuuuagguccacuaugcccggaugcagcggguaucccaacaugaauuuggauugccuacucccccaggagugggugcagcacuucuaucaagagucagccccagcacaaucugauguggcacugcugagauuugugaauccagacacagguaggguuuuguuugagugcaagcuucauaagucaggcuauguaacaguggcucacacuggccaacaugauuugguuaucccccccaauggcuauuuuagauuugauuccugggucaaccaauucuacacacuugcccccaugggaaauggagcggggcguagacgugcauuauaa

SEQ ID NO: 6031 - RNA, 1623 nt, Artificial Sequence
  capsid_protein__Norovirus__ABW74542
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccagcagugccuucguuguucaaccacaaaauggcaggugcacgacugauggcgugcucuuagguacuacccaacugucuccugucaacaucugcaccuucagaggggaugucacccacauugcugguacucaagaauacacaaugaaucuggccucccaaaacuggaacaauuaugacccaacagaagaaaucccagccccucugggaacuccagauuucguggguaagauccaaggcgugcucacccaaaccacaaggagggauggcucgacccgcggucacaaagccacagugagcacuggaaguguccacuucaccccaaagcugggcagaauucaauucuccacugauacaagcaaugauuuugaaacuggccaaaacacgagauucaccccagucgguguuguccaggaugguaguaccacccaccaaaaugaaccccaacaauggguacucccaaauuauucagguagagauagucacaaugugcaccuagccccugccguggcccccucuuuuccgggugagcaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucacaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6032 - RNA, 1623 nt, Artificial Sequence
  capsid_protein__Norovirus__ABW74544
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuguggagcgcgcccuuaggcccugaucugaaucccuaccuaucucauuuggccagaauguauaaugguuaugcaggugguuuugaagugcaagugauccucgcggggaacgcguucaccgccggaaaaauuauauuugcagcagucccaccaaauuuuccaacugaaggcuugagccccagccaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugccgaguccucacgaggccauccccugauuuugauuucauauuuuuggugccaccuacaguugagucaagaacuaaaccauuuacugucccaaucuuaacuguugaagagaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacucacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuuguaaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6033 - RNA, 1623 nt, Artificial Sequence
  capsid_protein__Norovirus__ABW74545
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccauuuggccagaauguacaauaguuaugcaggugguuuugaagugcagguaauccucgcggggaacgcguucaccgccggaaaaaucauauuugcagcagucccaccaaauuucccaacugaaggcuugagccccagccagguuacuauguucccccauauaauaguagauguuaggcaacuggaaccuguguugauccccuuacccgauguuaggaauaauuucuaucacuacaaucaaucaaaugaccccaccaucaaauugauagcaauguuguauacaccacuuagggcuaauaaugcuggggacgaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccagcagugccuuuguuguucaaccacaaaauggcaggugcacgacugauggcgugcuccuagguacuacccaacugucuccugucaacaucugcaccuucagaggggaugucacccacauugcagguacucaagaauacacaaugaaucuggccucccaaaacuggaacaauuaugacccaacagaagaaaucccagccccucugggaacuccagauuucguggguaagauccaaggcgugcucacccaaaccacaaggagggauggcucgacccguggucacaaagccacagugagcacuggaaguguccacuucaccccaaagcugggcagaauucaauucuccacugauacaagcaaugauuuugaaacuggccaaaacacgagauucaccccagucgguguuguccaggaugguaguaccacccaccaaaaugaaccccaacaaugggugcucccaaauuauucagguagagauagucacaaugugcaccuagccccugcuguggcccccucuuuuccgggugagcaacuucuuuucuucagguccacuaugcccggaugcagcggguaucccaacaugaauuuggauugccuacucccccaggagugggugcagcacuucuaccaagaggcagccccagcacaaucugauguggcucugcuaagauuugugaauccagacacagguaggguucuguuugaguguaagcuucauaaaucaggcuaugucacaguggcucacacuggccaacaugauuuaguuaucccccccaauggcuauuuuagguuugauuccugggucaaccaguucuacacacuugcccccaugggaaauggaacggggcguaggcgugcauuauaa

SEQ ID NO: 6034 - RNA, 1623 nt, Artificial Sequence
  capsid_protein__Norovirus__ABW74546
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgccauuaggcccugaucugaaucccuaccuaucucauuuggccagaauguauaaugguuaugcaggugguuuugaagugcaggugauccuugcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguacacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgaccgauggcgugcucuuaggcaccacccaauugucuccugucaacaucugcaccuucagaggggaugucacccacauugcagguucucguaauuacacaaugaauuuggcuucucuaaacuggaacaauuaugacccaacagaagaaauuccagccccucuaggaacuccagauuucguaggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccuggugaacaacuucuuuucuuuagguccacuaugcccggaugcagcggguaucccaacauggauuuggauugccuacucccccaggagugggugcagcacuuccaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaguucuacacacuugcccccaugggaaauggaacggggcguagacgugcuuuauaa

SEQ ID NO: 6035 - RNA, 1566 nt, Artificial Sequence
  capsid_protein__Norovirus__ABW75843
augaagaugagugacaaggaaucagcagagucuccugccucccuuggccagguucucccuccccaaguugauguuguuguuccaguugagcccacuguuggcgcgcagauugcugccccaacugcuggacaaaucaaucccauugacccauggauuuuuagcaauuuuguucaagccccccagggugaguuuaccauauccccaaauaauaauccuggagagauuuuguuugagauggaacuuggcccagauuugaaccccuaucuugggcauuugcgccggauguauaacggcuggaccggcucccugcgcguucgcgugaugcuggccggcaacgccuuuucugcagggaagauuauugucuuuugcauuccaccaggguuugauaccaccuuucucacuccagcccaggccacccaauucccacaugucaucauggaugugcgggcucccgacccuguugaggucccccuugaggauguccgcaacguucuuuuccaucagggcccugacaaccggaugcgguugguuggcaugcucuacacacccuugcgugcuaauucuggagcugacccguuuguggucacugggcguguccuuacuugcccaagugaaaacuuuuccuuuuucuuuuugguuccccccacgguugaagagaaggacgucccuuucacuauccccaaugucccaaccucgagccuuaccaauucucgcauguuggagccaguggccgagcugcgcagcucucgcaacuuugccuugucagugcaguuccagaacgggcgguccaccaucgaaggugaauugcucggcaccacuccggcuucccuugcugauuuggguucuuuccucugcauccgcgggggcacggccaaccuugcagaguuguuucaacccaaugaggacgccuuuguggcuggcucccauccugccccauuuggcuuuccugauuuuucuaauugcacccuagacuuuuugcuuuaugaugccaacggcuuguaccaccgccauuuggauguuaccucugcuagcaauuucaccccugcccucgggcacaucacacucgaugguucggucccugaccgcuuaacccgcgcccgccuggagggagugcagcgggcaagugagaacaccuuuuggcguaugcccgacuaccguggugaugugcuuggagcagaguuugccccggcugugucagccccagggauuggugagacucuucuuuucuuuauguccaauguccccuaucacaaugguuccaauccuaacccccugcccugcuugcucccguuagaguggaucaaucauuuuguggcggagcguccugcaaagcagagugauguggcccuccucaacuacauuaacccacuuacugggcgcguguuguuugaguguaaauuguacucugcuggcuuuuuagcaguuaaucugggaucucagacugaggugacuuugccaguggauggaauuuuuaaauuuguuucuuggguuucuuauuauuaucaacuccggccugugggaacaguuagugucggccgucgccuuccccgacuugauggccacuga

SEQ ID NO: 6036 - RNA, 1737 nt, Artificial Sequence
  capsid_protein__Norovirus__ABX71062
augaagauggcgucuaacgacgcugcuccaucgucagauggugcuggcaaccucguuccagagagucaccaagagguauugccacuugcccccguagcaggcgcggcuauagcugcaccaguuguggggcaacagaacauaauugaccccuggauuaaagaaaauuuugugcaggccccccagggugaguucaccgugucaccuaagaacucuccuggugaaguccuuguuaauuuggaguugaguccaaaauugaaucccuauuuggaucaucuuucuaaaauguauaaugccuaugcugguggcauggagauugaaauaauccuugcagggaaugcguucacugcaggcaaggugcucauagcggcagucccccccaacuucccaguugagaauaucucggucucccaggccagucaauucccccaugugauuguggaugucaggacccuugagccaauccgccuaccccugcccgaugugcgcaccaauuucuuccauuauaccaccagagaugaaccaaagaugcgcauaguugcguggcucuauaccccauugaggacaaauggcaguggagaugacuccuucacaguuucagggcgcauauuaacccgcccaucugcugauuuugaguucuccuuucuuguaccaccaacuguugagaccaaaaccgucuccuucucaguccccggccuaacggucgaggagauguccaacuccagguggcccgcccagaucaaugggcugguggucagaggcaaugaggcucaaguuguucacuuccaaaacggcagguguaccacugaaggcaugcuccuuggcacaacaacucucaaugucaauuccaucuguggccuacggggcacaucaauuucacaugccuccgugcgcgaagccccugcacucagugaggagaugccgccacuugaagaugaaguggcccacggcgcugcugccaccuaugccguuggucgugcugcugacaccacccuauggaucaggguagaggaacccaauggacagcccuaugacaucuuuggggaacaaccagcgccacuggggacucccgauuucacggcagugaucaucggcaccgccaucagaccacgcacugccaguggugcguaccuucaugaugccuauguggauaccagaccaggugaugcagauuucacccccucaacuggcaacaccaagaucguguugcgugggggugguaguggccaugucggcgagggccacuauuggcaauucaagcccaucgccguugaggguggcccaaacaggccuguuuaccaggaauacaaccugccugaguaugccgggcccaccgcauccaaucacaaucuggcgccaccagucgcccccaagaugcccggugagcuccuguugcucuuugagucggacaugccggucugggacaaugggaguggcuccgcccccacacaaaagauucauugucugcuccccaaugauuuugucacccacuucuuugauuuacaagccccagcccuugcugaagccgcccuccuaagguauguccacccugauaguggcagaacucucuucgagugcaagcucuacagggagggcuacaugguugugguugcccccucaggcagacuggauuucccacuggauggguauuucagguuugauuccugggucaaugcuuucuauguccuuucccccgugggaaacggccaaggccgucgggguagagccaagaacaucuaa

SEQ ID NO: 6037 - RNA, 1605 nt, Artificial Sequence
  capsid_protein__Norovirus__ABY77754
augaagauggcgucgaaugacgcuaguccguccagugacggaucagccaaccucgucccagagaucaacaaugagguaauggcccuugaaccaguggcuggugcugcuauugcugccccgguugcugggcagcaaaauauaauagaucccuggauuagaaacaauuuugugcaggccccugguggugaguucaccguuucaccaagaaacgccccgggggaagugcuucuaaauuuaccuuuaagcccugauaucaauccauauuuggcccauuugucccgaauguauaaugguuaugcuggagguguggagguggaggugguccucgccgggaaugcguucacggcgggaaaaaucaucuuugccgcagugccacccaauuuuccuccugagaaccuuaguccaagucaaauaacaaugcuuccccacauuauaguugaugucaggcaauuagagccagugcgcauaccccuaccagaugugcgcaacaauuucuaucauuauucuagagaaaaugauucuacauugagauugguugcaaugcuguacacuccccuuagagcuaauaaugcuggugaugauguguucacugucucuuguagaguguugacaaggccuucuccugauuuugauuuuauauuccuggugccacccacgguugaaucuaaaucuaagcccuucaccaucccaauacucacuauugaggaaaugaccaauuccagguucccugcuccguuagagaugaugaccacaggaccgagccacgacauuguugugcagccacaaaacggacgcugcaccauugaugguguguugcucggcacuacacagcuguccccaguuaacaucugcuccaugagggguguccccaccaagcgaaccaaugggacugauaauugcuuuguacaacuugagaauccaaaugguucagcuuaugauccaacagaggacauaccugcaguucuggggucaccugacuuugugggagaguucuacgggacaaucacccagagaagcccaaacaauucaacuagagcccacccuuuuacccuuaauacuggaagcccuagguacacucccaaaauuggcucaguggacauccaugucacagacguugaugaccucaacgaucacgagccagugaaacucacuccaguuggucucucugggagcagugguucaauccaucaguggcagcuuccaaacuacucaggaguggcaacccacaauaugcacuuggccccaucugucgcuccauuguucccuggugagcagauucuuuucuuccgguccacaguccccggguguggugguuacccaaacacaaacaucgacuguuugauuccucaagaguggguucaacacuucuaccaggaaggugcuccagcccguaccgauguggccuugcucagguucauaaacccugacacgggcagagugcucuuugagugcaaauugcauaaacauggcuucaucacuguggcuuauucuggaaaucaugauuugguuaugcccccaaaugguuacuucagauuugaaucuugggugaaucaauuucacacucuugcccccaugggaacaggucgggcagaagagauccaguaa

SEQ ID NO: 6038 - RNA, 1608 nt, Artificial Sequence
  capsid_protein__Norovirus__ABZ89549
augaagauggcgucgaaugacgcuaguccguccagugacggaucagccaaccucgucccagagaucaauaaugaggugauggcucuugaaccaguggcuggugcugcuauugcugccccgguugcugggcaacagaauauaauagaucccuggauuagaaauaacuuugugcaggccccugguggcgaguucacuguuucaccaagaaacgccccgggggaaguacuucuaaauuuaccucuaagcccugauaucaauccauauuuggcccauuugucccgaauguacaaugguuaugcuggaggcguggagguggaggugguccucgccgggaaugcguucacggcgggaaaaaucaucuuugccgcagugccacccaauuuuccuccugagaaccuuaguccaagucaaauaacaaugcucccccauaucauaguugaugucaggcaauuggaaccagugcgcauaccuuuaccagaugugcgcaacaauuucuaucauuauucuagagaaaaugacuccacauugagauugauugcaauguuguacacuccccuuagagcuaauaaugcuggugaugauguguuuacugucucuuguaggguguugacaaggccuucuccugauuuugauuucauauuccuggugccacccacaguugaaucuaaaucuaaacccuucacuaucccaauacucacuauugaggaaaugaccaauucuagguuuccugccccguuagagaugaugaccacagguccgagccacgacauuguugugcaaccacaaaacgggcgcugcaccauugauggcgugcugcucggcacuacacagcuguccccaguuaacaucugcuccaugagggguguuccuaccaagcgaaccaaugggacugacaauugcuuugugcaacucgagaacccaaacgguucagcuuaugauccaacagaggacauaccagcaguccuggggucaccugacuuugugggagaguucuacgggacaaucacccagaggagcccaaauaauucaacuagagcccacccuuucacccucaacacuggaagcccuagguacacucccaaaauuggcucaguggacauccacgucacagacguugaagaccucaacgaucacgagccagugaaacucacuccagucggucucucugguagcagugguucaauccaucaguggcagcugccaaauuacucaggaguggcaacccacaauaugcacuuggccccaucugucgcuccauuguucccuggugagcagauucuuuucuuccgguccacaguccccggguguggugguuauccaaacacaaacaucgacuguuugauuccucaagaguggguccaacacuucuaccaggaaggugcuccagcccguacugauguggcccugcucagauuuguaaacccugacacgggcagagugcucuuugaguguaaauugcauaagcauggcuuuauuacuguggcuuacucuggaaaccaugauuugguuaugcccccaaaugguuauuuuagauuugagucuugggugaaucaauuucacacucuugcccccaugggaacagguucgggcagaaggagaauccaguaa

SEQ ID NO: 6039 - RNA, 1644 nt, Artificial Sequence
  capsid_protein__Norovirus__ACC69023
augaagauggcgucuaaugacgcccccccaucuacggauggaucugccggucucguaccagaggucaacaaugagaccauggcccuugaaccaguggugggcgcuccccuugcugcucccgucgcuggucagcauaauauaauagaccccuggauuaaaaugaauuuugugcaggcaccuaauggagaguuuacuguuuccccucguaaugccccaggugagauuuuguuagauuuggaacuuggcccugaccuuaaccccuaucuuucacaucuggcccgcauguauaauggauacgcgggcggcauggaggcgcaagucgugcuggcuggcaaugcuuucacugcuggaaagauuauuuuugcugcuguuccaccaaacuucccagcggagaaucucagcgcggcgcaagucaccaugugcccucaugugauaguugauguuaggcaguuagaaccagucauguuacccaugccugauaucaggaacaaguuguuucauuauaaucaaguugaugacccuaagcuuagauuauuagccuaccuuuauacaccucuccgagccaauaaugcuggggaugauguuuuuaccguuucuugccggguguuaacuaggccaaccccagauuuugaguucauguuuuugguccccccuacuguugaaucaaaaacuaagcccuuuucuuugccuggucucacucuugaugaacuuuccaacucuagguuuccugcuccuauagugcagcuuuacacaaauccucaugauaaucugguugugcaaccccaaaauggaagauguaccauagauggccuuuugcagggcaccacacagcuuguguccuguaauguuugcagcuauaggggaaccaucggcgguggccagccggccagccacacugaagaggaaauuaugcccauggcuuucaacauccagcgugagaucauguuggaaaaucuugauggcucgcccuacgacccaguugaugacaucccugcaguucuggguucccccgauuuccagggggucguauucgguauccucagucagaggaaugcuaaugggcagacuagggcacacgaagccaagguugacaccagggcggcccgcuuugccccuaagcuugguuuuguuguagccacuguggagaguacagacuuccaugauaaucaaccuagcagguucgccccuguugggcuagguggaaauggaaaucaggauuuuaaccaaugggcgcugccagccuacgguggugcacugacaaacaacaccaaucuugccccaccugugaugccuguuuauccaggagaacagcuucuuuucuuucgcucucaacuaccaagcucugguggugugguugguggguggcuggauugucugcucccucaggaguggguccaacacuucuuucaagagucagcuacuucccagagugauguggccuugguuagguacauaaaucccacuacaggcagaguacuuuuugaggcaaaauuacacaaacagggcuuccucacuguggcugcuucugguuccuacccccugguuguucccgcugaugguuauuuuagguuugagucuugggugaaucaauuuuacacuuuggcccccaugggaaauggcagugggcguaggagagcucguuaa

SEQ ID NO: 6040 - RNA, 1644 nt, Artificial Sequence
  capsid_protein__Norovirus__ACC69026
augaagauggcgucuaacgacgcccccccaucuacggauggaucugccggucucguaccagaggucaacaaugagaccauggcccuugaaccaguggugggcgcuccccuugcugcucccgucgcuggucagcauaauauaauagaccccuggauuaaaaugaauuuugugcaggcaccuaauggagaguuuacuguuuccccucguaaugccccaggugagauuuuguuagauuuggaacuuggcccugaccuuaaccccuaucuuucacauuuggcccgcauguauaauggauacgcgggcggcauggagguacaaguugugcuggcuggcaaugcuuuuacugcuggaaagauuauuuuugcugcuguuccaccaaacuucccagcggagaaucucagcgcggcgcaagucaccaugugcccucaugugauaguugauguuaggcaguuagaaccagucauguuacccaugccugauaucaggaacaaguuguuucauuacaaucaaguugaugacccuaagcuuagauuauuagccuaccuuuauacaccucuccgagccaauaaugcuggggaugauguuuuuaccguuucuugccggguguuaacuaggccaaccccagauuuugaguucauguuuuugguccccccuacuguugaaucaaaaacuaagcccuuuucuuugccuggucucacucuugaugaacuuuccaacucuagguuuccugcuccuauagugcagcuuuacacaaauccucaugacaaucugguugugcaaccccaaaauggaagauguacuauagauggccuuuugcagggcaccacacagcuuguguccuguaaugucugcagcuuuaggggaaccaucggcgguggccagccggccagccacagugaagaggaaauuaugcccauggcuuucaacauccagcgugagaucauguuggaaaaucuugauggcucacccuacgacccagcugaugacaucccugcaguucuggguucccccgauuuucagggggucguauuugguauccucagucagaggaaugcuagugggcagacuagggcacacgaagccaagguugacaccagggcggcccgcuuugccccuaagcuugguuuuguuguagccacuguggagaguacagacuuccaugauaaucaaccuagcagguucaccccuguugggcuagguggaaauggaaaucaggauuuuaaccaaugggcgcugccagccuacgguggugcacugacaaacaacaccaaucuugccccaccugugaugccuguuuauccaggagaacagcuucuuuucuuucgcucucaacuaccaagcucugguggugugguugguggguggcuggauugucugcucccucaggaguggguccaacacuucuuucaagagucagcuacuucccagagugauguggccuugguuagguacauaaaccccacuacaggcagaguacuuuuugaggcaaaauuacacaaacaggguuuccucacuguggcugcuucugguuccuacccccugguuguucccgcugaugguuauuuuagguuugaaucuugggugaaucaauuuuacacuuuggcccccaugggaaauggcagugggcguaggagagcucguuaa

SEQ ID NO: 6041 - RNA, 1671 nt, Artificial Sequence
  capsid_protein__Norovirus__ACC69028
augaagauggcgucuaacgaugucgcugcuccaucuacggauggaucugccggucucguaccagaggucaacaaugagaccauggcacuagagcccguggcgggggcggcacuugccgcgccugucguagggcaacauaauguuauugaccccuggauuagagguaauuuuguucaagcccccaauggagaauuuacuguuuccccccguaauucccccggggagguccugcugaauuuggaauuagguccugagcuaaaucccuauuuggcccaucucgcucgcauguacaauggguaugcuggcggaauggagguucagguggugcucgcugggaaugcguucgcagcgggaaagaucaucuuugcugccgucccgccaagcuucccuguugaugcuuugagcgcgcccacuauaacgaugugcccucacguuauaguggaugugagacaguuagaaccaguguugcuucccaugccagauguuagaaauaauuucuuucauuacaaucagaguucugaucccaagcuucgauuaguugcaaugcuuuauacaccccugagggcuaauagcccaacagaugauguuuucacuguuuccuguagaguucuuacuaggccaucuccugauuuugaguucacuuuccugauacccccuacaguugagucuaaaaguaagccccuuacuaucccucagcucacucugucugaacuuuccaauucgagauuuccugcucccauugacaugcugaacacgagucccaaugauaacauuguggugcagccccaaaauggaaggugcacccuugauggugaauugcagggcacaacccagcuccaaccgagccucaucugcuccuuucggggaguggugcucaaugaaaccucccggauggcaguugauuacgaggaggaggaagaggugcagcgcccacaggcccgcgcauuuaaccaugaauaccaccuucaauuacaaaaccuugaugguacugauuaugacccugcaggggaccuccccgcgacucugggagcgccugacuuugucgggacgguuuauggaguggucagccaacgcaccacucgugacagcgcagccagagcgcaugaggccaagauuaucaccaaugacccuagauaugccccuaaacuuggaucaguugaguuugugacagaaucuacagauauugugauaaaugaucagaccaaauuuaccccuguuggccuugcucauaaucgggcaguugauuauaaacaaugggagcugccgcacuaugcgggagagcucacugcuaacaccaaccuggcccccccuguggcaccuguuuacccuggugagcaguugcuguucuuucgcucaaaucuuccucucgcgggcggcacggcugcaaguguucuugauuaucuuuugccccaagaauggauucagcauuuuuaucaggaguccuuuacuccccagucugauauugcccuucugagguaugugaacccugauacaggcagaguucuuuuugaagcgaagcuacaccggcaagguuacauaacuguagcuggugcaggcaccagccccguggccguucccccaaacggcuacuuuagguuugagucuuggguuucacaguuuuacgcauuggcccccaugggaucugggacggggcguagaaggaaucaguaa

SEQ ID NO: 6042 - RNA, 1626 nt, Artificial Sequence
  capsid_protein__Norovirus__ACC96732
auggggaugagugauggcgcagcgccaaaagccaacggcucugaagccagcggccaggaucuuguuccuaccgccguugaacaggccguccccauucagcccguggcuggugcggcucuugccgcccccgccgccgggcaaauuaaccaaauugaccccuggaucuuccaaaauuuuguccagugcccccuuggugaguuuuccauuucaccucgaaacaccccaggugaaauauuguuugauuuggcccuugggccagggcucaaccccuaccuugcccaccucucagccauguacaccggcuggguugggaacauggagguucagcugguccucgccggcaaugccuuuacugcuggcaaggugguuguugcccuuguaccacccuauuuccccaaagggucacucaccaccgcccagaucacgugcuucccacaugucaugugugaugugcgcacccuggagcccauucaacucccucuucuugacgugcgucgaguccuuuggcaugcuacccaggaucaagaggaaucuaugcgccuggucugcauguuguacacgccacuccgcacaaacagcccgggugaugagucuuuuguggucucuggccgccuucuuucuaagccggcggcugauuucaauuuugucuaucugaccccucccauagagagaaccaucuaccggauggucgacuugcccgugauacagccgcggcugugcacgcgcgcacguuggccugccccggucuauggccuuuuaguggacccaucccuccccucaaacccccaguggcagaauggaagagugcauguugauggaacccugcuuggcaccaccccaaucuccggcucauggguguccugcuucgcggcggaggcugccuaugaguuccgcucggguacuggugaggaggugacguucacccugauugagcaagauggaucugccuacgucccuggcgauagggcagcaccacucgguuaucccgauuucuccgggcaacuggagaucgagguucagaccgagaccaccaagacuggagacaagcucaaggucaccaccuuugagaugauucuuggcccaaggaccaacguggaccaggcccccuaccagggcagggcguacgccagcgucaaugccacggccucucuuaacuugguggauggcaggguucgugcggucccaagauccauucacaguuuccaagaugucaucccugaauacaaugaugggcuacugguuccccuugcucccccaauuggucccuuucuuccgagcgagguucuccugagguuccgaaccuacaugcgucagauugacaccgcugacgcugcugcagaggcaauagacugcgcacucccccaggaguucgucuccugguucgcguccaacgcguucacugugcaguccgaagcccugcuccuuagguacaggaacacccugacugggcaacugcuguuugagugcaagcucuacagcgaaggcuacaucgcuuuguccuauucuggcucaggaccccucaccuucccgacugauggcuucuuugaagucgucagcugggucccccgccuuuaucaauuggccucugugggaagcuuggcaacgggccgaacacucaaacaauaa

SEQ ID NO: 6043 - RNA, 1626 nt, Artificial Sequence
  capsid_protein__Norovirus__ACC96735
augaggaugagugauggcgcagcgccaaaagccaacggcucugaggccagcggccaggaucuuguuccuaccgccguugaacaggccguccccauucagcccguggcuggcgcggcucuugccgcccccgccgcugggcaaauuaaccaaauugaccccuggaucuuccaaaauuuuguccaaugcccccuuggugaguuuuccauuucaccucgaaacaccccaggugagauauuguuugauuuggcccuugggccagggcucaaccccuaccuugcccaccucucagccauguacaccggcuggguugggaacauggagguucagcugguccucgccggcaaugccuuuacugcuggcaaggugguuguugcccuuguaccacccuauuuucccagggggucacucaccaccacccagaucacgugcuucccacaugucaugugugaugugcgcaccuuggagcccauucaacucccucuucuugacgugcgucgaguccuuuggcaugcuacccaggaucaagaggaaucuaugcgccuggucugcaugcuguacacgccacuccgcacaaacagcccgggugaugagucuuuuguggucucuggccgccuucuuucuaagccggcggcugauuucaauuuugucuaccugaccccccccauagagagaaccaucuaucggauggucgacuugcccgugguacagccgcggcugugcacgcacgcacguuggccugccccgaucuauggccuuuuaguggacccaucccuccccucaaacccccaguggcagaauggaagagugcauguugauggaaccuugcuuggcaccaccccaaucuccggcucauggguguccuguuuugcggcagaggcugccuaugaguuccaaucggguacuggugagguggcgacguucacuuugauugagcaagauggaucugccuaugucccuggcgauagggcagcaccacucgguuaucccgacuucuccgggcaacuggagaucgagguucagaccgagaccaccaagacuggagacaagcucaaggucaccaccuuugagaugauucuugguccagaaaccaacgaggaccaggcccccuaccagggcagaguguucgccagcauuagcgccgcggccucucuugauuugguggaugguaggguucgugcgguuccaagguccaucuacggcuuccaagauguuaucccugaauacaaugaugggcugcugguuccccuugcucccccaauuggucccuuccuucccggugagguccuccugagguuccgaaccuacaugcgucagguugacacccaagacgcugcagcagaggcaauagacugcgcacucccccaggaguucgucuccugguucgcguccaacgcguucacugugcaguccgaagcccugcuccuuagguacaggaacacccuaacuggacagcuacuguuugagugcaagcucuacagcgaaggcuacaucgcuuuguccuauucuggcccaggaccccucaccuucccaucuaauggcuucuuugaggucgucagcugggucccccgccuuuaucaauuggccucugugggaagcuuggcaacaggccgaacacucaaacaauaa

SEQ ID NO: 6044 - RNA, 1623 nt, Artificial Sequence
  capsid_protein__Norovirus__ACF41177
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuaggaauaauuuuguacaagccccugguggagaguucacaguauccccuagaaacgcuccaggugaaauacuauggagcgcgcccuuaggcccugaucugaauccauaccuuucucaccuggccagaauguacaaugguuacgcaggugguuuugaagugcagguaauccucgcggggaacgcguucaccgccgggaagaucauauuugcagcagucccaccaaauuucccaacugaaggcuugagccccagccaggucacuauguucccccacauaauaguagauguuaggcaauuggaaccuguguugauccccuuaccugauguuaggaauaauuucuaccauuacaaucaaucaaaugacuccaccauuaaauugauagcaaugcuguacacaccacuuagggcuaauaaugcuggggaugaugucuucacagucucuugccgaguccucacgaggccaucccccgauuuugauuucauauuccuggugccacccacaguugagucaagaaccaaaccauucaccgucccaaucuuaacuguugaggaaaugaccaauucaagauucccaauuccuuuggaaaaauuguucacgggucccagcagugccuuugucguccaaccacaaaauggcaggugcacgacugauggcgugcucuuaggcacuacccaacugucccccgucaacaucugcuccuucagaggcgaugucacccacauuccagguacucguacuuacaggaugaauuuggcuucucaaaauuggaacaauuaugacccaacagaagagaucccagccccucugggaacuccagauuucgugggaaagauccaaggcaugcucacccaaaccacaaagggagacggcucgacccgcggucacaaagcuacagugagcacugggaguguugacuuuacuccaaagcugggcagcguucaguucgccacugauacagacaaugauuuugaaacuggccaaaacacaagguucaccccagucggugucauccaggaugguaguaguacccacagaaaugaaccccaacaaugggugcucccagauuacucagguagaacuguucauaauguacaccuggccccugccguagcccccacuuuuccgggugagcaacuucuuuucuucagaucuacuaugcccggaugcaguggguaucccaauauggauuuggauugucuacucccccaggaaugggugcagcacuucuaccaagaggcagccccaucacaaucugauguggcuuuguugagauuugugaauccagacacagguaggguucuguuugagugcaagcuucauaaggcaggcuaugucacaguggcucacacuggccagcaugauuugguuaucccccccaauggcuacuuuagauuugauuccugggucaaccaguucuacacacuugcccccaugggaaauggagcggggcguagacgugcaucauaa

SEQ ID NO: 6045 - RNA, 1623 nt, Artificial Sequence
  capsid_protein__Norovirus__ACF41180
augaagauggcgucgaaugacgccaccccaucugacggguccacagccaaccucgucccagaggucaacaaugagguuauggcuuuggagcccguuguuggugccgcgauugcggcaccuguagcgggccaacaaaauguaauugaccccuggauuagaaacaauuuuguacaagccccugguggagaguuuacaguauccccuagaaacgcuccaggugaaauauuauggagcgcacccuugggcccugauuugaaucccuaccuuucccacuuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugaucccccugccugauguuaggaauaauuuuuaucauuacaaccaaucaaaugaccccaccaucaaauugauagcaaugcuguauacaccacucagggcuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagauucccuauuccuuuggaaaaguuguucacgggucccagcagugccuuuguuguucagccacaaaauggcagaugcacgacugauggcgugcucuuagguacuacccaauugucuccugucaacaucugcaccuucagaggggacgucacccacauugcagguacucaaaauuacacaaugaaucuggccucccaaaauuggaacaauuaugacccaacagaagaaaucccagccccucugggaaccccagauuuuguaggaaagauccaaggcgugcucacccaaaccacaaagagggauggcucgacccgcggucacaaagccacagugagcacuggaaguguccacuuuaccccaaagcugggcaguguucaguucuccacugauacaagcaaugacuuugaaauuggccaaaacacaagauucaccccagucgguguuguccaagaugguaguaccacccaccaaaaugaaccccaacaaugggugcucccaaacuauucagguagagauggucacaauguacaccuagccccugcuguggcccccacuuucccgggugagcaacuucuuuucuuuagguccacuaugcccggaugcagcggguaucccaacaugaauuuggauugccuacucccccaggagugggugcaacacuucuaccaagagucagcuccagcacaaucugauguggcacuguugagauuugugaauccagacacagguagggccuuguuugagugcaagcuucauaaaucaggcuauguaacaguggcucacacuggccaacaugauuugguuaucccccccaauggcuauuuuagauuugauuccugggucaaccaauucuacacacuugcccccaugggaaauggagcggggcguagacgugcauuauaa

SEQ ID NO: 6046 - RNA, 1623 nt, Artificial Sequence
  capsid_protein__Norovirus__ACF41181
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuaggaauaauuuuguacaagccccugguggagaguucacaguauccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaagaucauauuugcagcagucccaccaaauuucccaacugaaggcuugagccccagccaggucacuauguucccccacauaauaguagauguuaggcaauuggaaccuguguugauccccuuaccugauguuaggaauaauuucuaccauuacaaucaaucaaaugauuccaccauuaaauugauagcaaugcuguacacaccacuuagggcuaauaaugcuggggaugaugucuucacagucucuugccgaguccucacgaggccaucccccgauuuugauuucauauuucuggugccacccacaguugagucaagaaccaaaccauucaccgucccaauuuuaacuguugaggaaaugaccaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggcgaugucacccacauuccagguacucguacuuacagaaugaauuuggcuucucaaaauuggaacaauuaugacccaacagaagagaucccagccccucugggaacuccagauuucgugggaaagauccaaggcaugcucccccaaaccacaaagggagacggcucaacccgcggucacaaagcuacagugagcacugggaguguugacuuuacuccaaagcugggcagcguucaguucgccacugauacagacaaugauuuugaaacuggccagaacacaagguucaccccagucggugucauccaggaugguaguaguacccacagaaaugaaccccaacaauggguacucccagauuacucagguagaacuguuuauaauguacaccuggccccugccguagcccccacuuuuccgggugagcaacuucuuuucuucagaucuacuaugcccggaugcaguggguaucccaauauggauuuggauugucuacucccccaggaaugggugcagcacuucuaccaagaggcagccccaucacaaucugauguggcuuuguugagauuugugaauccagacacagguaggguucuguuugagugcaagcuucauaaagcaggcuaugucacaguggcucacacuggucagcaugauuugguuaucccccccaauggcuauuuuagauuugauuccugggucaaccaguucuacacacuugcccccaugggaaauggagcggggcguagacgugcauuauaa

SEQ ID NO: 6047 - RNA, 1623 nt, Artificial Sequence
  capsid_protein__Norovirus__ACF41182
augaagauggcgucgaaugacgccagcccaucugauggguccacagccaaccucgucccagaggucaacaaugagguuauggcuuuggagcccguuguuggugccgcuauugcggcaccuguaacgggccaacaaaauguaauugaccccuggauuaggaauaauuuuguacaagccccugguggagaguucacaguauccccuagaaacgcuccaggugaaauacuauggagcgcgcccuuaggcccugaucugaauccauaccuuucucaccuggccagaauguacaaugguuaugcaggugguuuugaagugcagguaauccucgcggggaaugcguucaccgccgggaaaaucauauuugcagcagucccaccaaauuucccaacugaaggcuugagccccagccaggucacuauguucccccacauaauaguagauguuaggcaauuggaaccuguguugauccccuuaccugauguuaggaauaacuucuaccauuacaaucaaucaaaugacuccaccauuaaauugauagcaaugcuguacacaccacuuagggcuaauaaugcuggggaugacgucuucacagucucuugucgaguccucacgaggccaucccccgauuuugauuuuauauuucuggugccacccacaguugagucaagaaccaaaccauucaccgucccaauuuuaacuguugaggaaaugaccaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggcgaugucacccacauuccagguacucguacuuacagaaugaauuuggcuucucaaaauuggaacaauuaugacccaacagaagagaucccagccccucugggaacuccagauuucgugggaaagauccaaggcaugcucacccaaacuacaaagggagacggcucgacccgcggucacaaagcuacagugagcacugggaguguugacuucacuccaaagcugggcagcguucaguucgccacugauacagacaaugauuuugaaacuggccaaaacacaagguucaccccagucggugucauccaggaugguaguaguacccacagaaaugaaccccaacaauggguacucccagauuacucagguagaacugcucauaauguacaccuggccccugccguagcccccacuuuuccgggugagcaacuucuuuucuucagaucuacuaugcccggaugcaguggguaucccaauauggauuuggauugucuacucccccaggaaugggugcagcacuucuaccaagaggcagccccaucacaaucugauguggcuuuguugagauuuguaaauccagacacagguaggguucuguuugagugcaagcuacauaaagcaggcuaugucacaguggcucacacuggccagcaugauuugguuaucccccccaaugguuacuuuagauuugauuccugggucaaccaauucuacacacuugcccccaugggaaauggagcggggcguagacgugcauuauaa

SEQ ID NO: 6048 - RNA, 1623 nt, Artificial Sequence
  capsid_protein__Norovirus__ACF41183
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuaggaauaauuuuguacaagccccugguggagaguuuacaguauccccuagaaacgcuccaggugaaauacuauggagcgcgcccuuaggcccugaucugaauccauaccuuucucaccuggccagaauguacaaugguuaugcaggugguuuugaagugcaaguaauccucgcggggaacgcguucaccgccgggaaaaucauauuugcagcagucccaccaaauuucccaacugaaggcuugagccccagccaggucacuauguucccccacauaauaguagauguuaggcaauuggaaccuguguugauccccuuaccugauguuaggaauaauuucuaucauuauaaucaaucaaaugacuccaccauuaaauugauagcaaugcuguacacaccacuuagggcuaauaaugcuggggaugaugucuucacagucucuugucgaguccucacgaggccaucccccgauuuugauuucauauuucuggugccacccacaguugagucaagaaccaaaccauucaccgucccaauuuuaacugucgaggaaaugaccaauucaagauuccccaucccuuuggaaaaauuguucacgggucccagcagugccuuugucguccaaccacaaaauggcaggugcacuacugauggcgugcucuuaggcacuacccaacugucccccgucaacaucugcaccuucagaggcgaugucacccacauuccagguacucgugcuuacagaaugaauuuggcuucucaaaauuggaacaauuaugacccaacagaagaaaucccagccccucugggaacuccagauuucgugggaaagauccagggcaugcucacccaaaccacaaagggagacggcucgacccgcggucacaaagcuacagugagcacugggaguguugacuucacuccaaagcugggcagcguucaguucgccacugauacagacaaugauuuugaaacuggccaaaacacaagguucaccccagucggugucauccaggaugguaguaguacccacagaaaugaaccccaacaauggguacuuccagauuacucagguagaacuguucauaauguacaccuggccccugccguagcccccacuuuuccgggugagcaacuucuuuucuucagaucuacuaugcccggaugcaguggguaucccaauauggauuuggauugucuacucccccaggaaugggugcagcacuucuaccaagaggcagccccaucacaaucugauguggcuuuguugagauuugugaauccagacacagguaggguucuguuugagugcaagcuucauaaagcaggcuaugucacaguggcucacacuggccagcaugauuugguaauuccccccaauggcuacuuuagauuugauuccugggucaaccaguucuacacacuugcccccaugggaaauggagcggggcguagacgugcauuauaa

SEQ ID NO: 6049 - RNA, 1623 nt, Artificial Sequence
  capsid_protein__Norovirus__ACF41184
augaagauggcgucgaaugacgccaacccaucugauggguccgcagccaaccucgucccagaggucaacaaugaggucauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugaucccccuaccugauguuaggaauaacuucuaucacuauaaucagucaaaugauucuaccauuaaguugauagcaaugcuguauacaccacuuagggcuaauaaugcuggggaagaugucuuuacagucucuugucgaguucucacgaggccauccccugauuuugauuuuauauuuuuggugccaccuacagucgagucaagaacuaaaccauuuacuguuccaaucuuagcuguugaagaaaugaccaauucaagauuccccauuccuuuggaaaaauuguucacgggucccagcagugccuuaguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucgguacugauacagaaaaugauuuugaaacucaccaaaacacaaaauucaccccagucggcgucauccaggaugguagcaccacccaccgaaaugaaccccaacaaugggugcucccaaguuauucagguagaaauguccauaauguacaccuagccccugcuguagcccccacuuuuccgggugaacaacuucuuuucuuuagguccacuaugcccggaugcagcggguaucccaacauggauuuggauugccuacucccccaggagugggugcaacacuucuaccaagaggcagcuccagcacaaucugauguggcucuauugagauuugugaauccagacacggguaggguccuguuugagugcaaacuucauaaaucaggcuaugucacaguggcucacaccggccagcaugaucuggucaucccccccaaugguuauuuuagguuugauuccuggguuaaucaauucuacacacuugcccccaugggaaauggaacggggcguagacgugcuuuauaa

SEQ ID NO: 6050 - RNA, 1623 nt, Artificial Sequence
  capsid_protein__Norovirus__ACF41185
augaagauggcgucgaaugacgcuaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggcgaaauacuauggagcgcgcccuuaggcccugaucugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugagccccagccagguuacuauguucccccacauaauaguagauguuaggcaauuggaaccuguguugauccccuuaccugauguuaggaacaacuucuaucauuauaaucagucaaaugauucuaccauuaaauugauagcaaugcuguauacaccacuuagggcuaauaaugcuggggaugaugucuucacagucucuugucgaguccucacgaggccauccccugauuuugauuuuauauuuuuggugccaccuacaguugagucaagaacuaaaccauuuacugucccaaucuuaacuguugaagaaaugacuaauucaagauuccccauuccuuuggaaaaguuguucacgggucccagcggugccuuuguuguucaaccacaaaauggcagaugcacgacugauggcgugcuccuaggcaccacccaacugucuccugucaacaucugcaccuucagaggggaugucacccacauugcagguucucgugacuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauuccguacugauacagaaaaugauuuugaaacucaccaaaacacaaaauucaccccagucggugucauccaggaugguagcaccacccaccgaaaugaaccccaacaaugggugcucccaaguuauucagguagaaauguccacaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccaacaugauuuggucaucccccccaauggcuauuuuagguuugauuccuggguuaaucaauucuacacacuugcccccaugggaaauggaacggggcguagacgugcuuuauaa

SEQ ID NO: 6051 - RNA, 1623 nt, Artificial Sequence
  capsid_protein__Norovirus__ACF41186
augaagauggcgucgaaugacgccaacccaucugguggguccgcagccaaccucgucccagaggucaacaaugagguuauggcuuuggagcccguugucggagccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucccauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcuuuuaggcaccacccaacugucuccugucaacaucugcaccuucagaggggaugucacccacauugcagguucucguaauuacacaaugaauuuggcuucucuaaauuggaacaauuaugacccaacagaagaaaucccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucagcacugauacagaaaaugauuuugaaacucaccaagacacaaaauucaccccagucggugucauccaggaugguggcaccacccaccgaaaugaaccccaacaaugggugcucccaaguuauucagguagaaauguccaaaauguacaccuagccccugcuguagcccccacuuuuccgggugaacaacuucuuuucuuuagguccacuaugcccggauguagcggguaucccaacauggauuuggauugccuacucccccaggagugggugcagcauuucuaccaagaggcagcuccagcacaaucugauguggcucuauugagauucgugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaaugggacggggcguagacgugcuuuauaa

SEQ ID NO: 6052 - RNA, 1623 nt, Artificial Sequence
  capsid_protein__Norovirus__ACF41187
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucacuuggccagaauguauaaugguuaugcaggcgguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugccgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccgaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccaccuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugaaugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 6053 - RNA, 1623 nt, Artificial Sequence
  capsid_protein__Norovirus__ACF41188
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugagggcuugagucccagccagguuacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggagaaauuguucacgggucccaguagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagacuucgugggaaagauccaaggugugcucacucaaaccacaaagggagauggcucgacccguggccauaaagcuacagcuuacacugggagugcccccuuuacuccaaagcugggcaguguucaauucaguacugauacagaaaaugauuuugaaacucaccaaaacacaaaauucgccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 6054 - RNA, 1623 nt, Artificial Sequence
  capsid_protein__Norovirus__ACF41190
augaagauggcgucgaaugacgccaacccaucugauggguccgcagcuaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgaccgauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacagucuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcaguggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaaugggacggggcguagacgugcuuuauaa

SEQ ID NO: 6055 - RNA, 1623 nt, Artificial Sequence
  capsid_protein__Norovirus__ACF41191
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugguuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguucgagugcaaacuucauaaaucaggcuaugucacaguggcucacaccggccagcaugauuuggucaucccccccaaugguuauuuuagguuugauuccuggguuaaucaauucuacacacuugcccccaugggaaaugggacggggcguagacgugcuuuauaa

SEQ ID NO: 6056 - RNA, 1647 nt, Artificial Sequence
  capsid_protein__Norovirus__ACF60293
augaagauggcgucgaaugacgccacuccaucuaaugauggugccgccggccucgucccagagaucaacaaugaggcaauggcgcuagauccaguggcgggugcagcgauagcagcaccccucacuggucagcaaaauauaauugaucccuggauuaugaauaauuuugugcaagcaccugguggugaguuuacaguauccccuaggaauuccccuggugaagugcuucucaauuuggaauugggcccagaaauaaaucccuauuuggcucaucuugcuagaauguauaaugguuaugcagguggauuugaagugcagguaguccuagcuggaaaugcguuuacagcaggaaagauaaucuuugcagcuauacccccuaauuucccaauugaaaaucuaagcgcagcacagaucacaaugugcccacaugugauuguggaugucagacaguuggaaccggucaaccuuccgaugccugacguucgcaauaacuucuuccauuacaaccaagggucugauucgaaauugcgcuuaguugcaauguuguauacaccucuuagggcaaauaauucuggggaugauguuuuuacugugucuuguagagugcugacuaggccuagcccugacuuuucauuuaauuuccuugugccaccuacuguggagucaaagacaaaacccuucacccucccuauucugacuaucucugaaauguccaauucgagguuuccagugccgauugauucucugcacaccagcccaacugagaauauuguuguccagugccaaaauggacgcgucacucuugauggugaguugaugggcaccacccaacucuuaccuagucaaaucugugcuuuuaggggcgugcucaccagaucaacaagcagggccagugaccaggccgacacggcaaccccuagguuguuuaauuauuacuggcacauacaauuggauaaucuaaacgggacuccuuaugauccugcagaagacauaccaggcccccuagggacaccagauuuccggggcaaagucuuuggcguggccagccagagaaaucccgacagcacaacuagagcacaugaagcaaagguggacacaacagcuggucguuucaccccaaaacuaggcucauuagagauauccacugaaucuggugacuuugaucaaaaccaaccaacaagauucaccccaguuggcauugggguugaccacgaggcagauuuccaacaauggucuuuacccgacuauucuggucaguucacccacaacaugaacuuagccccagcuguugcccccaacuucccuggugagcagcuccuuuucuuccgcucacaguuaccaucuucuggugggcgauccaacgggauucuagacugccgggucccccaagaauggguucagcacuucuaccaagaaucggcccccgcccaaacucaaguggcccugguuagguaugucaacccugacacugguagaguguuguuugaggccaagcugcacaaauuagguuucaugacuauagcuaagaauggugacucuccaauaaccguccccccaaauggauacuuuagguuugaaucuugggugaacccauuuuauacacuugcccccaugggaacugggaaugggcguagaaggauucaauaa

SEQ ID NO: 6057 - RNA, 1647 nt, Artificial Sequence
  capsid_protein__Norovirus__ACF60294
augaagauggcgucgaaugacgccacuccaucuaaugauggugccgccggccucgucccagagaucaacaaugaggcaauggcgcuagauccaguggcgggugcagcgauagcagcaccccucacuggucagcaaaauauaauugaucccuggauuaugaauaauuuugugcaagcaccugguggugaguuuacaguauccccuaggaauuccccuggugaagugcuucucaauuuggaauugggcccagaaauaaaucccuauuuggcccaucuugcuagaauguauaaugguuaugcagguggguuugaagugcagguaguccuagcuggaaaugcguuuacagcaggaaagauaaucuuugcagcuauacccccuaauuucccaauugauaaucuaagugcagcacagaucacaaugugcccacaugugauuguggaugucagacaguuggaaccggucaaccuuccgaugccugacguucgcaauaacuucuuccauuacaaccaagggucugauucgagauugcgcuuaguugcaaugcuguauacaccucuuagggcaaauaauucuggggaugauguuuucacugugucuuguagagugcugacuaggccuagcccugacuuuucauuuaauuuccuugugccaccuacuguggagucaaagacaaaacccuucacccucccuauucugacuaucucugaaauguccaauucuagguuuccagugccgauugacucuuugcacaccagcccaacugagaauauuguuguccagugccaaaauggacgcgucacucuugauggugaguugaugggcaccacccaacucuuaccuagucaaaucugugcuuuuaggggcgugcucaccagaucaacaagcagggccagugaccaggccgacacagcaaccccuagguuguuuaauuauuauuggcacauacaauuggauaaucuaaaugggacuccuuaugauccugcagaagacauaccaggcccccuagggacaccagauuuccggggcaaagucuuuggcguggccagccagagaaaucccgacagcacaacuagagcacaugaagcaaagguggacacaacagcuggucguuuuaccccaaaacuaggcucauuagagauauccacugaaucuggugacuuugaucaaaaccaaccaacaagauucaccccaguuggcauugggguugaccacgaggcagauuuccaacaauggucuuuacccgacuauucuggucaguucacccacaacaugaacuuagccccagcuguugcucccaacuucccuggugagcagcuccuuuucuuccgcucacaguuaccaucuucuggugggcgauccaacgggauucuagacugccuggucccccaagaauggguucagcacuuuuaccaagaaucggcccccgcccaaacucaaguggcccugguuagguaugucaacccugacacugguagaguguuguuugaggccaagcugcacaaauuagguuucaugacuauagcuaagaauggugacucuccaauaacuguccccccaaauggauacuuuagguuugaaucuugggugaacccauuuuauacacuugcccccaugggaacugggaaugggcguagaaggauucaauaa

SEQ ID NO: 6058 - RNA, 1647 nt, Artificial Sequence
  capsid_protein__Norovirus__ACF60295
augaagauggcgucgaaugacgccacuccaucuaaugauggugccgccggccucgucccagagaucaacaaugaggcaauggcgcuagauccaguggcgggugcagcgauagcagcaccccucacuggucagcaaaauauaauugaucccuggauuaugaauaauuuugugcaagcaccugguggugaguuuacaguauccccuaggaauuccccuggugaagugccucucaauuuggaauugggcccagaaauaaaucccuauuuggcccaucuugcuagaauguauaaugguuaugcagguggguuugaagugcagguaguccuagcuggaaaugcguuuacagcaggaaagauaaucuuugcagcuauacccccuaacuucccaacugauaaucuaagugcagcacagaucacaaugugcccacaugugauuguggaugucagacaguuggaaccggucaaccuuccgaugccugacguucgcaauaauuucuuccauuacaaccaagggucugauucgagauugcgcuuaguugcaaugcuguauacaccucuuagggcaaauaauucuggggaugauguuuucacugugucuuguagagugcugacuaggccuagcccugacuuuucauuuaauuuccuugugccaccuacuguggagucaaagacaaaacccuucacccucccuauucugacuaucucugaaauguccaauucuagguuuccagugccgauugauucucugcacaccagcccaacugagaauauuguuguccagugccaaaauggacgcgucacucuugauggugaguugaugggcaccacccaacucuuaccuagucaaaucugugcuuuuaggggugugcucaccagaucaacaagcagggccagugaccaggccgacacagcaaccccuagguuguuuaauuauuauuggcacauacaauuggauaaucuaaaugggacuccuuaugauccugcagaagacauaccaggcccccuagggacaccagauuuccggggcaaagucuuuggcguggccagccagagaaaucccgacagcacaacuagagcacaugaagcaaagguggacacaacagcuggucguuuuaccccaaaacuaggcucauuagagauauccacugaaucugaugacuuugaucaaaaccaaccaacaagauucaccccaguuggcauugggguugaccacgaggcagauuuccaacaauggucuuuacccgacuauucuggucaguucacccacaacaugaacuuagccccagcuguugcucccaacuucccuggugagcagcuccuuuucuuccgcucacaguuaccaucuucuggugggcgauccaacgggauucuagacugccuggucccccaagaauggguucagcacuucuaccaagaaucggcccccgcccaaacucaaguggcccugguuagguaugucaacccugacacugguagaguguuguuugaggccaagcugcacaaauuagguuucaugacuauagcuaagaauggugauucuccaauaacuguccccccaaauggauacuuuagguuugaaucuugggugaacccauuuuauacacuugcccccaugggaacugggaaugggcguagaaggauucaauaa

SEQ ID NO: 6059 - RNA, 1647 nt, Artificial Sequence
  capsid_protein__Norovirus__ACF60296
augaagauggcgucgaaugacgccacuccaucuaaugauggugccgccggccucgucccagagaucaacaaugaggcaauggcgcuagauccaguggcgggugcagcgauagcagcaccccucacuggccagcaaaauauaauugaucccuggauuaugaauaauuuugugcaagcaccugguggugaguuuacaguauccccuaggaauuccccuggugaagugcuucucaauuuggaauugggcccagaaauaaaucccuauuuggcccaucuugcuagaauguauaaugguuaugcagguggguuugaagugcagguaguccuagcuggaaaugcguuuacagcaggaaagauaaucuuugcagcuauacccccuaauuuuccaauugauaaucuaagcgcagcacagaucacaaugugcccacaugugauuguggaugucagacaguuggaaccggucaaccuuccgaugccugacguucgcaauaacuucuuccauuacaaccaggggucugauucgagauugcgcuuaguugcaaugcuguauacaccucuuagggcaaauaauucuggggaugauguuuucacugugucuuguagagugcugacuagaccuaguccugacuuuucauuuaauuuccucguuccaccuacuguggagucaaagacaaaacccuucacccucccuauucugacuaucucugaaauguccaauucuagguuuccagugccgauugauucucugcacaccagcccaacugagaauauuguuguccagugccaaaauggacgcgucacucuugauggugaguugaugggcaccacccaacucuuaccuagucaaauuugugcuuuuaggggcgugcucaccagaucaacaagcagggccagugaccaggccgacacagcaaccccuagguuguuuaauuacuauuggcacauacaauuggauaaucuaaaugggacuccuuaugauccugcagaagacauaccaggcccccuagggacaccagauuuccggggcaaagucuuuggcguggccagccagagaaaucccgacagcacaacuagagcacaugaagcaaagguggacacaacagcuggucguuuuaccccaaaacuaggcucauuagagauauccacugaaucugaugacuuugaccaaaaccaaccaacaagauucaccccaguuggcauugggguugaccaugaggcagauuuccaacaauggucuuuacccgacuauucuggccaguucacccacaacaugaacuuagccccagcuguugcucccaacuucccuggugagcagcuccuuuucuuccgcucacaguuaccaucuucuggugggcgauccaacgggauucuagacugccuggucccccaagaauggguucagcacuucuaccaagaaucggcccccgcccaaacucaaguggcccuggucagguaugucaacccugacacugguagaguguuguuugaggccaagcugcacaaauuagguuucaugacuauagcuaagaauggugacucuccaauaacuguccccccaaauggauacuuuagguuugaaucuugggugaacccauuuuauacacuugcccccaugggaacugggaaugggcguagaaggauucaauaa

SEQ ID NO: 6060 - RNA, 1647 nt, Artificial Sequence
  capsid_protein__Norovirus__ACF60297
augaagauggcgucgaaugacgccacuccaucuaaugauggugccgccggccucgucccagagaucaacaaugaggcaauggcgcuagauccaguggcgggugcagcgauagcagcaccccucacuggucagcaaaauauaauugaucccuggauuaugaauaauuuugugcaagcaccugguggugaguuuacaguauccccuaggaauuccccuggugaagugcuucucaauuuggaauugggcccagaaauaaaucccuauuuggcccaucuugcuagaauguauaaugguuaugcagguggguuugaagugcagguaguccuagcuggaaaugcguuuacagcaggaaagauaaucuuugcagcuauacccccuaacuucccaauugauaaucuaagugcagcacagaucacaaugugcccacaugugauuguggaugucagacaguuggaaccggucaaccuuccgaugccugacguucgcaauaauuucuuccauuacaaccaagggucugauucgagauugcgcuugguugcaaugcuguauacaccucuuagggcaaauaauucuggggaugauguuuucacuguaucuuguagagugcugacuaggccuagcccugacuuuucauuuaauuuccuugugccaccuacuguggagucaaagacaaaacccuucacccucccuauucugacuaucucugaaauguccaauucuagguuuccagugccgauugauucucuguacaccagcccaacugagaauauuguuguccagugccaaaauggacgcgucacucuugauggugaguuggugggcaccacccaacucuuaccuagucaaaucugugcuuuuaggggcgugcucaccagaucaacaagcagggccagugaccaggccgacacagcaaccccuagguuguuuaauuauuauuggcacauacaauuggauaaucuaaaugggacuccuuaugauccugcagaagacauaccaggcccccuagggacaccagauuuccggggcaaagucuuuggcguggccagccagagaaaucccgacagcacaacuagagcacaugaagcaaagguggacacaacagcuggucguuuuaccccaaaacuaggcucauuagagauauccacugaaucuggugacuuugaucaaaaccaaccaacaagauucaccccaguuggcauugggguugaccacgaggcagauuuccaacaauggucuuuacccgacuauucuggucaguucacccacaacaugaacuuagccccagcuguugcucccaacuucccuggugagcagcuccuuuucuuccgcucacaguuaccaucuucuggugggcgauccaacgggauucuggacugccuggucccccaagaauggguucagcacuucuaccaagaaucggcccccgcccaaacucaaguggcccugguuagguaugucaacccugacacugguagaguguuguuugaggccaagcugcacaaauuagguuucaugacuauagcuaagaauggugacucuccaauaacuguccccccaaauggauacuuuagguuugaaucuugggugaacccauuuuauacacuugcccccaugggaacugggaaugggcguagaaggauucaauaa

SEQ ID NO: 6061 - RNA, 1626 nt, Artificial Sequence
  capsid_protein__Norovirus__ACF72688
augaggaugagugauggcgcagcgccaaaagccaacggcucugaagccagcggccaggaucuuguuccuaccgccguugaacaggccguccccauucagcccguggcuggugcggcucuugccgcccccgccgccgggcaaaucaaccaaauugaccccuggaucuuccaaaauuuuguccaaugcccccuuggugaguuuuccauuucaccucgaaacaccccaggugaaauacuguuugaucuggcccucggaccagggcucaauccuuaccuugcccaccucucagccauguacaccggcuggguugggaacauggagguucagcugguccucgccggcaaugccuuuacugcuggcaaggugguuguugcccuuguaccacccuauuuuuccaaagggucacucaccacugcucagaucacaugcuucccacaugucaugugugaugugcgcacccuggagcccauucaacucccucuucuugacgugcgucgaguucuuuggcaugcuacccaggaucaggaggaaucuaugcgccugguuugcaugcuguacacgccacuccgcacaaacagcccgggugaugagucuuuuguggucucuggccgccuucuuucuaagccggcaccugauuucaauuuuguauaccugaccccccccaucgagagaaccaucuaccggauggucgacuugcccuuguugcagccgcggcugugcacgcacgcucguuggccggccccggucuacggccucuugguagacccaucccuuccauccaauccccaguggcagaaugguagagugcauguugaugggacccuucuugguacaacaccuguaucuggcucuuggguuuccugcuuugcagcugaggccgccuacgaguuccaaucugggauuggugaggugguaaccuucaccaugauugagcaggacggguccgcauauguccccggcgacagggcggccccccuuggguacccugacuucuccgggcaacuggagaucgaggugcagacugaaaccaccaagacgggcgacaagcucaaggugaccaccuuugaaaugauccugggccccaccaccaacguggaccaggcccccuaccagggcagggcauacgcgagccugacggccauggccucgcucgaccugguggacgggagaguuagggcagucccacgcuccaucuauuccuuccaagaugagcucccagaauacaaugauggucuuuugguuccccuugccccacccuuaggucccuuccuuccuggugagguuuuguugagguuucgcaccuacaugcgccagcuugacaccgcugacgccgcagcgcagccgauugacugugccuugccccaggaguuuaucuccugguuugcaagcaacaacuucacaguccagucggacgcgcuccugguuagguaucggaacaccuuaaccggccagcuccuguuugaggcuaagcuuuauagugaaggcuacauugcugugucuuacucaggguccggcccucucaccuuccccacugacggcuucuuugagguugucagcugggucccccgccucuuucaauuggccucugugggaagcuuggcaacaggccgaacacucaaacaauaa

SEQ ID NO: 6062 - RNA, 1623 nt, Artificial Sequence
  capsid_protein__Norovirus__ACH42093
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaauggcuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugauccccuugccugauguuaggaauaauuucuaucauuacaaucaaucaaaugaccccaccaucaaauugauagcaaugcuguauacaccacuuagggcuaacaaugcuggggacgaugucuucacagucucuugucgaguucucacgagaccaucccccgauuuugauuucauauuuuuggugccacccacaguugagucaagaacuaaaccauuuucugucccaaucuuaacuguugaggagaugaccaauucaagauucccuauuccuuuggaaaaguuguucacgggucccagcagugccuuuguuguucaaccacaaaauggcagaugcacgacugauggcgugcucuuagguacuacccaacugucuccugucaacaucugcaccuucagaggggaugucacccacauugcagguacucaaaauuacacaaugaaucuggccucccaaaauuggaacaauuaugacccaacagaagaaaucccagccccucugggaaccccagauuuuguaggaaagauccaaggcgugcucacccaaaccacaaggagggauggcucgacccgcggucacaaagccacagugagcacuggaaguguccacuuuaccccaaagcugggcaguguucaauucuccacugauacaagcaaugacuuugaaacuggccaaaacacgaaauuuaccccagucggugucguccaggaugguaguaccacccaccaaaaugaaccccaacaaugggugcucccagacuauucagguagagauagucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguuuuguuugagugcaagcuucauaagucaggcuauguaacaguggcucacacuggucaacaugauuugguuaucccccccaauggcuauuuuagauuugauuccugggucaaccaauucuacacacuugcccccaugggaaauggagcggggcguagacgugcauuauaa

SEQ ID NO: 6063 - RNA, 1623 nt, Artificial Sequence
  capsid_protein__Norovirus__ACH42094
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaauggcuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugauccccuugccugauguuaggaauaauuucuaucauuacaaucaaucaaaugaccccaccaucaaauugauagcaaugcuguauacaccacuuagggcuaacaaugcuggggacgaugucuucacagucucuugucgaguucucacgagaccaucccccgauuuugauuucauauuuuuggugccacccacaguugagucaagaacuaaaccauuuucugucccaaucuuaacuguugaggagaugaccaauucaagauucccuauuccuuuggaaaaguuguucacgggucccagcagugccuuuguuguucaaccacaaaauggcagaugcacgacugauggcgugcucuuagguacuacccaacugucuccugucaacaucugcaccuucagaggggaugucacccacauugcagguacucaaaauuacacaaugaaucuggccucccaaaauuggaacaauuaugacccaacagaagaaaucccagccccucugggaaccccagauuuuguaggaaagauccaaggcgugcucacccaaaccacaaggagggauggcucgacccgcggccacaaagccacagugagcacuggaaguguccacuuuaccccaaagcugggcaguguucaauucuccacugauacaagcaaugacuuugaaacuggccaaaacacgagauucaccccagucggugucguccaggaugguaguaccacccaccaaaaugaaccccaacaaugggugcucccagacuauucagguagagauagucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguuuuguuugagugcaagcuucauaagucaggcuauguaacaguggcucacacuggucaacaugauuugguuaucccccccaauggcuauuuuagauuugauuccugggucaaccaauucuacacacuugcccccaugggaaauggagcggggcguagacgugcauuauaa

SEQ ID NO: 6064 - RNA, 1623 nt, Artificial Sequence; identical to SEQ ID NO: 6063
  capsid_protein__Norovirus__ACH42096

SEQ ID NO: 6065 - RNA, 1623 nt, Artificial Sequence
  capsid_protein__Norovirus__ACH42097
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcaggugauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugauccccuugccugauguuaggaacaauuucuaucauuacaaucaaucaaaugaccccaccaucaaauugauagcaaugcuguauacaccacuuagggcuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagauucccuauuccuuuggaaaaguuguucacgggucccagcagugccuuuguuguucaaccacaaaauggcagaugcacgacugauggcgugcucuuagguacuacccaacugucuccugucaacaucugcaccuucagaggggaugucacccacauugcagguacucaaaauuacacaaugaaucuggccucccaaaauuggaacaauuaugacccaacagaagaaaucccagccccucugggaaccccagauuuuguaggaaagauccaaggcgugcucacccaaaccacaaggagggauggcucgacccgcggucacaaagccacagugagcacuggaaguguccacuuuaccccaaagcugggcaguguucaauucuccacugauacaagcaaugacuuugaaacuggccaaaacacgagauucaccccagucggugucguccaggaugguaguaccacccaccaaaaugaaccccaacaaugggugcucccagacuauucagguagagauagucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguuuuguuugagugcaagcuucauaaaucaggcuauguaacaguggcucacacuggccaacaugauuugguuaucccccccaauggcuauuuuagauuugauuccugggucaaccaauucuacacacuugcccccaugggaaauggagcggggcguagacgugcauuauaa

SEQ ID NO: 6066 - RNA, 1623 nt, Artificial Sequence
  capsid_protein__Norovirus__ACH42098
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaauggcuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugauccccuugccugauguuaggaauaauuucuaucauuacaaucaaucaaaugaccccaccaucaaauugauagcaaugcuguauacaccacuuagggcuaacaaugcuggggacgaugucuucacagucucuugucgaguucucacgagaccaucccccgauuuugauuucauauuuuuggugccacccacaguugagucaagaacuaaaccauuuucugucccaaucuuaacuguugaggagaugaccaauucaagauucccuauuccuuuggaaaaguuguucacgggucccagcagugccuuuguuguucaaccacaaaauggcagaugcacgacugauggcgugcucuuagguacuacccaacugucuccugucaacaucugcaccuucagaggggaugucacccacauugcagguacucaaaauuacacaaugaaucuggccucccaaaauuggaacaauuaugacccaacagaagaaaucccagccccucugggaaccccagauuuuguaggaaagauccaaggcgugcucacccaaaccacaaggagggauggcucgacccgcggucacaaagccacagugagcacuggaaguguccacuuuaccccaaagcugggcaguguucaauucuccacugauacaagcaaugacuuugaaacuggccaaaacacgagauucaccccagucggugucguccaggaugguaguaccacccaccaaaaugaaccccaacaaugggugcucccagacuauucagguagagauagucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguuuuguuugagugcaagcuucauaagucaggcuauguaacaguggcucacacuggucaacaugauuugguuaucccccccaauggcuauuuuagauuugauuccugggucaaccaauucuacacacuugcccccaugggaaauggagcggggcguagacgugcauuauaa

SEQ ID NO: 6067 - RNA, 1623 nt, Artificial Sequence
  capsid_protein__Norovirus__ACJ66263
augaagauggcgucgaaugacgccaacccaucugauggguccacagccaaccucgucccagaggucaacaaugagguuauggcuuuggagcccguuguaggugccgcuauugcggcgccuguagcgggccaacaaaauguaauugaccccuggauuagaaauaacuuuguacaagccccugguggagaguucacaguguccccuagaaaugcuccaggugagauacuauggagugcgcccuugggcccugauuugaacccuuaccuuucucaucuggccagaauguacaaugguuaugcaggugguuuugaagugcagguaauccuugcggggaacgcguucaccgccggaaaaaucauauuugcagcagucccaccuaacuuuccaacugaaggcuugagccccagccagguuaccauguucccccauauaauaguagauguuaggcaauuggaaccuguguugauccccuuaccugauguuaggaauaauuuuuaucacuacaaccaaucaaaugacccuaccauuaaauugauagcaaugcuguacacaccacuuagggcuaauaaugcuggggaugaugucuucacagucucuugucgaguccucacgagaccauccccugauuuugauuuuauauuuuugguacccccaacaguugaaucaagaaccaaaccauucaccgucccaaucuuaacuguugaggaaaugaccaauucaagauuccccauuccuuuggaaagguuguacacgggucccagcagugcuuuuguuguccagccacaaaacggcaggugcacgacugauggcgugcucuuaggcaccacccagcugucugcugucaacaucugcaccuuuagaggagaugucacccauauugcaggcucucgcaauuauacaaugaauuuggccucucaaaauuggaauaacuaugauccaacagaagaaaucccagccccccugggcaccccagacuucgugggaaagauccaaggcaugcucacccaaacuacaagaagugauggcucgacccgcggccacaaggccacagugcucacugggagugccgacuuugccccaaaguugggcagaguccaauucgccaccgacacagacaacgauuucgaaucuggccaaaacacgaaauucaccccagucggcgucauccaggaugguuccaccacccaccgaaaugaaccccaacaauggguacucccaaauuacucagguagaacuggucauaaugugcaccuagccccugcaguugcccccacuuacccgggugagcaacuccuuuucuucagguccacuaugcccggauguagcggguaccccaacauggaucuagauugcuugcuuccccaggaaugggugcagcacuucuaccaagaagcagcuccagcacaaucugauguagcucugcuaagauuugugaauccagacacaggcaggguucuauuugagugcaagcuccauaaaucaggauaugucacaguggcucauacuggucagcaugauuugguuauucccccuaaugguuauuuuagauuugauuccugggucaaccaguuuuacacacuugcccccaugggaaauggagcggggcguagacgugcauuauaa

SEQ ID NO: 6068 - RNA, 1623 nt, Artificial Sequence
  capsid_protein__Norovirus__ACJ66265
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccacuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguccccccauauaauaguagauguuaggcaacuggaaccuguguugauccccuuacccgauguuaggaauaauuucuaucacuacaaucaaucaaaugaccccaccaucaaauugauagcaauguuguauacaccacuuagggcuaauaaugcuggggacgauguuuucacaguuucuugucgaguucucacgagaccaucccccgauuuugauuucauauuuuuagugccacccacaguugagucaagaaccaaaccauucucugucccaauuuuaacuguugaggagaugaccaauucaagauuccccauuccuuuggaaagguuguuuacgggucccagcagugccuuuguuguucaaccacaaaauggcaggugcacgacugauggcgugcuccuagguacuacccaacugucuccugucaacaucugcaccuucagaggggaugucacccacauugcaggcacucaagaauacacaaugaaucuggccucccaaaacuggaacaauuaugacccaacagaagaaaucccagccccucugggaacuccagauuucguggguaagauccaaggcgugcucacccaaacaacaaggagggauggcucgacccgcggucacaaagccacagugagcacuggaaguguccauuucaccccaaagcugggcagaauucaauucuccacugauacaagcaaugauuuugaaacuggccaaaacacgagauucaccccagucgguguuguccaggauggugguaccacccaccaaaaugaaccccaacaauggguacucccaaauuauucagguagagauggucacaaugugcaccuagccccugccguggcccccucuuuuccgggugagcaacuucuuuucuucagguccacuaugcccggaugcagcggguaucccaacaugaauuuggauugccuacucccccaggagugggugcagcacuucuaccaagaggcagccccagcacaaucugauguggcucugcuaagauuugugaauccggacacagguaggguucuauuugaguguaagcuucauaaaucaggcuauguuacaguggcucacacuggucaacaugauuuaguuaucccccccaauggcuauuuuagauuugauuccugggucaaccaguucuacacacuugcccccaugggaaauggaacggggcguagacgugcauuauaa

SEQ ID NO: 6069 - RNA, 1623 nt, Artificial Sequence
  capsid_protein__Norovirus__ACJ66267
augaagauggcgucgaaugacgccaacccaucugauggguccacagccaaccucgucccagaggucaacagugagguuauggcuuuggagcccguuguaggugccgcuauugcggcgccuguagcgggccaacaaaauguaaucgaccccuggauuagaaauaacuuuguacaagccccugguggagaguucacaguguccccuagaaaugcuccaggugagauacuauggagugcgcccuugggcccugauuugaacccuuaccuuucucaucuggccagaauguacaaugguuaugcaggugguuuugaagugcaaguaauccuugcggggaacgcguucaccgccggaaaaaucauauuugcagcagucccaccuaacuuuccaacugaaggcuugagccccagccagguuaccauguucccccauauaauaguagauguuaggcaauuggaaccuguguugauccccuuaccugauguuaggaauaauuucuaucacuacaaccaaucaaaugacccuaccauuaaauugauagcaaugcuguauacaccacuuagggccaauaaugcuggggaugaugucuucacagucucuugucgaguccucacgagaccauccccugauuuugauuuuauauuuuugguacccccaacaguugaaucaagaaccaaaccauucaccgucccaaucuuaacuguugaggaaaugaccaauucaagauuccccauuccuuuggaaagguuguacacgggucccagcagugcuuuuguuguccagccacaaaacggcaggugcacgacugauggcgugcucuuaggcaccacccagcugucugcugucaacaucugcaccuuuagaggagaugucacccauauugcaggcucucgcaauuauacaaugaauuuggccucucaaaauuggaauaacuaugauccaacggaagaaaucccagccccccugggcaccccagauuucgugggaaagauccaaggcaugcucacccaaacuacaagaagugauggcucgacccgcggccacaaagccacagugcucacugggagugccgacuuugccccaaaguugggcagaguccaauucgccacugacacggacaacgauuucgaaucuggccaaaacacgaaauucaccccagucggcgucauccaggaugguuccaccacccaucgaaaugaaccccaacaauggguacucccaaguuacucagguagaacuggucauaaugugcaucuagccccugcuguugcccccacuuacccgggugagcaacuccucuucuucagguccacuaugcccggauguagcggguaccccaauauggaucuagauuguuugcuuccccaggaaugggugcagcacuucuaccaagaagcagcuccagcacaaucugauguagcucugcuaagauuugugaauccagacacaggcaggguucuauuugagugcaagcuccauaaaucaggauauguuacaguggcucauacuggucagcaugauuugguuauucccccuaaugguuauuuuagauuugauuccugggucaaccaguuuuacacacuugcccccaugggaaauggagcggggcguagacgugcauuauaa

SEQ ID NO: 6070 - RNA, 1623 nt, Artificial Sequence
  capsid_protein__Norovirus__ACJ66269
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccacuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccauauaauaguagauguuaggcaacuggaaccuguguugauccccuuacccgauguuaggaauaauuucuaucacuacaaucaaucaaaugaccccaccaucaaauugauagcaauguuguauacaccacuuagggcuaauaaugcuggggacgauguuuucacaguuucuugucgaguucucacgagaccaucccccgauuuugauuucauauuuuuagugccacccacaguugagucaagaaccaaaccauucucugucccaauuuuaacuguugaggagaugaccaauucaagauuccccauuccuuuggaaagauuguuuacgggucccagcagugccuuuguuguucaaccacaaaauggcaggugcacgacugauggcgugcuccuagguacuacccaacugucuccugccaacaucugcaccuucagaggggaugucacccacauugcaggcacucaagaauacacaaugaaucuggccucccaaaacuggaacaauuaugacccaacagaagaaaucccagccccucugggaacuccagauuucguggguaagauccaaggcgugcucacccaaacaacaaggagggauggcucgacccgcggucacaaagccacagugagcacuggaaguguccauuucaccccaaagcugggcagaauucaauucuccacugauacaagcaaugauuuugaaacuggccaaaacacgagauucaccccagucgguguuguccaggaugguggcaccacccaccaaaaugaaccccaacaauggguacucccaaauuauucagguagagauggucacaaugugcaccuagccccugccguggcccccucuuuuccgggugagcaacuucuuuucuucagguccacuaugcccggaugcagcggguaucccaacaugaauuuggauugccuacucccccaggagugggugcagcacuucuaccaagaggcagccccagcacaaucugauguggcucugcuaagauuugugaauccggacacagguaggguucuauuugaguguaagcuucauaaaucaggcuauguuacaguggcucacacuggucaacaugauuuaguuaucccccccaauggcuauuuuagauuugauuccugggucaaccaguucuacacacuugcccccaugggaaauggaacggggcguagacgugcauuauaa

SEQ ID NO: 6071 - RNA, 1623 nt, Artificial Sequence
  capsid_protein__Norovirus__ACJ66271
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaccccuaccuuucccauuuggccagaauguacaaugguuaugcagguggcuuugaagugcagguaauccucgcggggaacgcguucaccgccggaaaaaucauauuugcagcagucccaccaaauuucccaacugaaggcuugagccccagccaggucacuauguucccccauauaauaguagauguuaggcaacuggaaccuguguugauccccuuacccgauguuaggaauaauuucuaucacuacaaucaaucaaaugaccccaccaucaaauugauagcaauguuguauacaccacuuagggcuaauaaugcuggggacgauguuuuuacaguuucuugucgaguucucacgagaccaucccccgauuuugauuucauauuuuuagugccacccacaguugagucaagaaccaaaccauucucugucccaauuuuaacuguugaggagaugaccaauucaagauuccccauuccuuuggaaagguuguuuacgggucccagcagugccuuuguuguucaaccacaaaauggcaggugcacgacugauggcgugcuccuagguacuacccaacugucuucugucaacaucugcaccuucagaggggaugucacccacauugcaggcacucaagaauacacaaugaaucuggccucccaaaacuggaacaauuaugacccaacagaagaaaucccagccccucugggaacuccagauuucguggguaagauccaaggcgugcucacccaaacaacaaggagggauggcucgacccgcggucacaaagccacagugagcacuggaaguguccauuucaccccaaagcugggcagaauucaauucuccacugauacaagcaaugauuuugaaacuggccaaaacacgagauucaccccagucgguguuguccaggaugguaguaccacccaccaaaaugaaccccaacaauggguacucccaaauuauucagguagagauggucacaaugugcaccuagccccugccguggcccccucuuuuccgggugagcaacuucuuuucuucagguccacuaugcccggaugcagcggguaucccaacaugaauuuggauugccuacucccccaggagugggugcagcacuucuaccaagaggcagccccagcacaaucugauguggcucugcuaagauuugugaauccagacacagguaggguucuauuugaguguaagcuucauaaaucaggcuauguuacaguggcucacacuggucaacaugauuuaguuaucccccccaaugguuauuuuagauuugauuccugggucaaccaguucuacacacuugcccccaugggaaauggaacggggcguagacgugcauuauaa

SEQ ID NO: 6072 - RNA, 1623 nt, Artificial Sequence
  capsid_protein__Norovirus__ACJ66273
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccauuuggccagaauguacaauaguuaugcaggugguuuugaagugcagguaauccucgcggggaacgcguucaccgccggaaagaucauauuugcagcagucccaccaaauuucccaacugaaggcuugagccccagccaggucacuauguucccccauauaauaguagauguuaggcaacuggaaccuguguugaucccuuuacccgauguuaggaauaauuucuaucacuacaaucaaucaaaugaccccaccaucaaauugauagcaauguuguauacaccacuuagggcuaauaaugcuggggacgaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccagcagcgccuuuguugugcaaccacaaaauggcaggugcacgacugauggcgugcucuuagguacuacccaacugucuccugucaacaucugcaccuucagaggggaugucacccacauugcugguacucaagaauacacaaugaaucuggccucccaaaacuggaacaauuaugacccaacagaagaaaucccagccccucugggaacuccagauuucgugggcaagauccaaggcgugcucacccaaaccacaaggagggauggcucgacccgcggucacaaagccacagugagcacuggaaguguccacuucaccccaaagcugggcagaauucaauucuccacugauacaagcaaugauuuugaaacuggccaaaacacgagauucaccccagucgguguuguccaggaugguaguaccacccaccaaaaugaaccccaacaauggguacucccaaguuauucagguagagauagucacaaugugcaccuagccccugccguggcccccucuuuuccgggugagcaacuucuuuucuucagguccacuaugcccggaugcagcggguaucccaacaugaauuuggauugucuacucccccaggagugggugcagcacuucuaccaagaggcagccccagcacaaucugauguggcucugcuaagauuugugaauccagacacagguaggguucuguuugaguguaagcuucauaaaucaggcuaugucacaguggcucacacuggccaacaugauuugguuaucccccccaauggcuauuuuagauuugauuccugggucaaccaguucuacacacuugcccccaugggaaauggagcggggcguagacgugcauuauaa
